(12) United States Patent
Tagliatela et al.

(10) Patent No.: US 12,083,188 B2
(45) Date of Patent: Sep. 10, 2024

(54) ENGINEERED DNA BINDING PROTEINS

(71) Applicant: Encoded Therapeutics, Inc., South San Francisco, CA (US)

(72) Inventors: Stephanie Tagliatela, San Francisco, CA (US); Anne Tanenhaus, Brisbane, CA (US); Kartik Ramamoorthi, San Francisco, CA (US); Andrew Young, Redwood City, CA (US); David Oberkofler, San Francisco, CA (US)

(73) Assignee: Encoded Therapeutics, Inc., South San Francisco, CA (US)

( * ) Notice: Subject to any disclaimer, the term of this patent is extended or adjusted under 35 U.S.C. 154(b) by 544 days.

(21) Appl. No.: 16/886,129

(22) Filed: May 28, 2020

(65) Prior Publication Data

US 2020/0397917 A1 Dec. 24, 2020

Related U.S. Application Data

(63) Continuation of application No. PCT/US2018/063498, filed on Nov. 30, 2018.

(60) Provisional application No. 62/664,817, filed on Apr. 30, 2018, provisional application No. 62/664,814, filed on Apr. 30, 2018, provisional application No. 62/646,198, filed on Mar. 21, 2018, provisional application No. 62/641,806, filed on Mar. 12, 2018, provisional application No. 62/618,966, filed on Jan. 18, 2018, provisional application No. 62/610,014, filed on Dec. 22, 2017, provisional application No. 62/593,824, filed on Dec. 1, 2017.

(51) Int. Cl.
*A61K 48/00* (2006.01)
*C07K 14/47* (2006.01)
*C07K 14/705* (2006.01)
*C12N 7/00* (2006.01)
*C12N 15/86* (2006.01)

(52) U.S. Cl.
CPC ...... *A61K 48/0058* (2013.01); *C07K 14/4705* (2013.01); *C07K 14/705* (2013.01); *C12N 7/00* (2013.01); *C12N 15/86* (2013.01); *C07K 2319/71* (2013.01); *C12N 2750/14143* (2013.01); *C12N 2800/30* (2013.01); *C12N 2830/008* (2013.01)

(58) Field of Classification Search
None
See application file for complete search history.

(56) References Cited

U.S. PATENT DOCUMENTS

| | | | |
|---|---|---|---|
| 5,789,538 A | 8/1998 | Rebar et al. | |
| 5,925,523 A | 7/1999 | Dove et al. | |
| 6,007,988 A | 12/1999 | Choo et al. | |
| 6,013,453 A | 1/2000 | Choo et al. | |
| 6,140,081 A | 10/2000 | Barbas | |
| 6,180,613 B1 | 1/2001 | Kaplitt et al. | |
| 6,200,759 B1 | 3/2001 | Dove et al. | |
| 6,303,370 B1 | 10/2001 | Kappen et al. | |
| 6,372,500 B1 | 4/2002 | Hu et al. | |
| 6,436,708 B1 | 8/2002 | Leone et al. | |
| 6,453,242 B1 | 9/2002 | Eisenberg et al. | |
| 6,479,626 B1 | 11/2002 | Kim et al. | |
| 6,503,717 B2 | 1/2003 | Case et al. | |
| 6,503,888 B1 | 1/2003 | Kaplitt et al. | |
| 6,524,851 B1 | 2/2003 | Ellis | |
| 6,534,261 B1 | 3/2003 | Cox, III et al. | |
| 6,566,118 B1 | 5/2003 | Atkinson et al. | |
| 6,599,692 B1 | 7/2003 | Case et al. | |
| 6,607,882 B1 | 8/2003 | Cox, III et al. | |
| 6,649,371 B1 | 11/2003 | Jentsch | |
| 6,689,558 B2 | 2/2004 | Case | |
| 6,794,136 B1 | 9/2004 | Eisenberg et al. | |
| 6,812,339 B1 | 11/2004 | Venter et al. | |
| 6,903,185 B2 | 6/2005 | Kim et al. | |
| 6,933,113 B2 | 8/2005 | Case et al. | |
| 6,989,264 B2 | 1/2006 | Atkinson et al. | |
| 6,994,993 B2 | 2/2006 | Qin et al. | |
| 6,998,118 B2 | 2/2006 | Kaspar et al. | |
| 7,030,215 B2 | 4/2006 | Liu et al. | |
| 7,067,317 B2 | 6/2006 | Rebar et al. | |
| 7,070,934 B2 | 7/2006 | Cox, III et al. | |
| 7,094,600 B2 | 8/2006 | Wang | |
| 7,101,540 B2 | 9/2006 | Kaspar et al. | |
| 7,125,676 B2 | 10/2006 | George, Jr. et al. | |
| 7,153,949 B2 | 12/2006 | Kim et al. | |

(Continued)

FOREIGN PATENT DOCUMENTS

| CA | 2985624 A1 | 6/2016 |
|---|---|---|
| CL | 2014000550 A1 | 9/2014 |

(Continued)

OTHER PUBLICATIONS

Zhang W, Guo Y, Zhang C, Ji H, Meng W, Wang D, Li X, Mao Q, Xia H. Rescue the failed half-ZFN by a sensitive mammalian cell-based luciferase reporter system. PLoS One. 2012;7(9):e45169. doi: 10.1371/journal.pone.0045169. Epub Sep. 18, 2012. PMID: 23028823; PMCID: PMC3445457. (Year: 2012).*

(Continued)

*Primary Examiner* — Allison M Fox
*Assistant Examiner* — Qinhua Gu
(74) *Attorney, Agent, or Firm* — Wilson Sonsini Goodrich & Rosati

(57) ABSTRACT

Provided herein are compositions and methods of use thereof comprising a non-naturally occurring DNA binding protein that modulates expression of an endogenous gene.

20 Claims, 40 Drawing Sheets

Specification includes a Sequence Listing.

(56) References Cited

U.S. PATENT DOCUMENTS

| | | |
|---|---|---|
| 7,157,571 B2 | 1/2007 | Wang et al. |
| 7,220,719 B2 | 5/2007 | Case et al. |
| 7,253,273 B2 | 8/2007 | Collingwood |
| 7,262,054 B2 | 8/2007 | Jamieson et al. |
| 7,358,085 B2 | 4/2008 | Zhang et al. |
| 7,361,635 B2 | 4/2008 | Miller et al. |
| 7,534,775 B2 | 5/2009 | Zhang et al. |
| 7,595,376 B2 | 9/2009 | Kim et al. |
| 7,655,460 B2 | 2/2010 | Rouleau et al. |
| 7,943,553 B2 | 5/2011 | Case et al. |
| 7,947,837 B2 | 5/2011 | Marks et al. |
| 8,137,948 B2 | 3/2012 | Qu et al. |
| 8,143,005 B2 | 3/2012 | Rouleau et al. |
| 8,304,235 B2 | 11/2012 | Passananti et al. |
| 8,524,874 B2 | 9/2013 | Liu et al. |
| 8,586,526 B2 | 11/2013 | Gregory et al. |
| 8,772,453 B2 | 7/2014 | Paschon et al. |
| 8,927,514 B2 | 1/2015 | Chatterjee et al. |
| 8,969,077 B2 | 3/2015 | Head et al. |
| 9,102,949 B2 | 8/2015 | Gao et al. |
| 9,267,151 B2 | 2/2016 | Guerrero et al. |
| 9,315,825 B2 | 4/2016 | Wilson et al. |
| 9,624,498 B2 | 4/2017 | Froelich et al. |
| 9,845,481 B2 | 12/2017 | Marengo et al. |
| 10,000,757 B2 | 6/2018 | Naldini et al. |
| 10,287,607 B2 | 5/2019 | Tagliatela et al. |
| 10,287,608 B2 | 5/2019 | Tagliatela et al. |
| 10,519,465 B2 | 12/2019 | Tagliatela et al. |
| 2002/0115215 A1 | 8/2002 | Wolffe et al. |
| 2002/0165356 A1 | 11/2002 | Barbas et al. |
| 2003/0017139 A1 | 1/2003 | Souza et al. |
| 2003/0051266 A1 | 3/2003 | Serafini |
| 2003/0082552 A1 | 5/2003 | Wolffe et al. |
| 2004/0096885 A1 | 5/2004 | Rouleau et al. |
| 2004/0191791 A1 | 9/2004 | Wallace et al. |
| 2004/0258666 A1 | 12/2004 | Passini et al. |
| 2005/0026169 A1 | 2/2005 | Cargill et al. |
| 2005/0032219 A1 | 2/2005 | Aubourg et al. |
| 2005/0064474 A1 | 3/2005 | Urnov et al. |
| 2005/0196754 A1 | 9/2005 | Drmanac et al. |
| 2005/0228172 A9 | 10/2005 | Wang |
| 2005/0260576 A1 | 11/2005 | George, Jr. et al. |
| 2005/0267061 A1 | 12/2005 | Martin |
| 2006/0292572 A1 | 12/2006 | Stuart et al. |
| 2007/0161031 A1 | 7/2007 | Trinklein et al. |
| 2007/0218528 A1 | 9/2007 | Miller |
| 2009/0018031 A1 | 1/2009 | Trinklein et al. |
| 2009/0062135 A1 | 3/2009 | Delfour et al. |
| 2009/0311222 A1 | 12/2009 | Baraban et al. |
| 2010/0086532 A1 | 4/2010 | Barbas, III et al. |
| 2010/0130594 A1 | 5/2010 | Barkats |
| 2011/0065100 A1 | 3/2011 | Aldred et al. |
| 2011/0135611 A1 | 6/2011 | Huang et al. |
| 2011/0165129 A1 | 7/2011 | Kriegstein et al. |
| 2011/0203007 A1 | 8/2011 | Klein et al. |
| 2011/0268747 A1 | 11/2011 | Guerrero Martinez et al. |
| 2013/0096183 A1 | 4/2013 | Collard et al. |
| 2013/0224836 A1 | 8/2013 | Muramatsu |
| 2013/0254909 A1 | 9/2013 | Marengo et al. |
| 2014/0037585 A1 | 2/2014 | Wright et al. |
| 2014/0142160 A1 | 5/2014 | Lee et al. |
| 2014/0162894 A1 | 6/2014 | Hatchwell et al. |
| 2015/0035917 A1 | 2/2015 | Asauchi |
| 2015/0044187 A1 | 2/2015 | Visel et al. |
| 2015/0071903 A1 | 3/2015 | Liu et al. |
| 2015/0111955 A1 | 4/2015 | High et al. |
| 2015/0253339 A1 | 9/2015 | Shekdar |
| 2015/0273029 A1 | 10/2015 | Gruber et al. |
| 2015/0353917 A1 | 12/2015 | Miller |
| 2016/0032319 A1 | 2/2016 | Wright et al. |
| 2016/0120960 A1 | 5/2016 | Mcivor et al. |
| 2017/0166903 A1 | 6/2017 | Zhang et al. |
| 2017/0218037 A1 | 8/2017 | Passananti et al. |
| 2019/0024118 A1 | 1/2019 | Tagliatela et al. |
| 2019/0024119 A1 | 1/2019 | Tagliatela et al. |
| 2019/0024120 A1 | 1/2019 | Tagliatela et al. |
| 2019/0024121 A1 | 1/2019 | Tagliatela et al. |
| 2020/0165628 A1 | 5/2020 | Tagliatela et al. |
| 2022/0193264 A1 | 6/2022 | Wood et al. |

FOREIGN PATENT DOCUMENTS

| | | |
|---|---|---|
| CN | 106170295 A | 11/2016 |
| EP | 1590467 B1 | 10/2009 |
| EP | 2130838 A2 | 12/2009 |
| EP | 1747277 B1 | 8/2011 |
| EP | 2698163 A1 | 2/2014 |
| EP | 3119878 A2 | 1/2017 |
| JP | 2018088888 A | 6/2018 |
| KR | 20120087860 A | 8/2012 |
| TW | 201514202 A | 4/2015 |
| TW | 201925474 A | 7/2019 |
| WO | WO-9519431 A1 | 7/1995 |
| WO | WO-9606166 A1 | 2/1996 |
| WO | WO-9853057 A1 | 11/1998 |
| WO | WO-9853058 A1 | 11/1998 |
| WO | WO-9853059 A1 | 11/1998 |
| WO | WO-9853060 A1 | 11/1998 |
| WO | WO-9854311 A1 | 12/1998 |
| WO | WO-0027878 A1 | 5/2000 |
| WO | WO-0130843 A1 | 5/2001 |
| WO | WO-0136620 A2 | 5/2001 |
| WO | WO-0138362 A2 | 5/2001 |
| WO | WO-0160970 A2 | 8/2001 |
| WO | WO-0185938 A1 | 11/2001 |
| WO | WO-0188197 A2 | 11/2001 |
| WO | WO-0216536 A1 | 2/2002 |
| WO | WO-02057294 A2 | 7/2002 |
| WO | WO-02066640 A2 | 8/2002 |
| WO | WO-02099084 A2 | 12/2002 |
| WO | WO-03016496 A2 | 2/2003 |
| WO | WO-03066828 A2 | 8/2003 |
| WO | WO-03076601 A1 | 9/2003 |
| WO | WO-2005042728 A2 | 5/2005 |
| WO | WO-2006108846 A1 | 10/2006 |
| WO | WO-2007069666 A1 | 6/2007 |
| WO | WO-2007078599 A2 | 7/2007 |
| WO | WO-2008073303 A2 | 6/2008 |
| WO | WO-2008118820 A2 | 10/2008 |
| WO | WO-2008129058 A1 | 10/2008 |
| WO | WO-2008142124 A1 | 11/2008 |
| WO | WO-2009044383 A1 | 4/2009 |
| WO | WO-2009060316 A2 | 5/2009 |
| WO | WO-2010037143 A1 | 4/2010 |
| WO | WO-2010148143 A1 | 12/2010 |
| WO | WO-2012087983 A1 | 6/2012 |
| WO | WO-2013033627 A2 | 3/2013 |
| WO | WO-2013123503 A1 | 8/2013 |
| WO | WO-2014161884 A2 | 10/2014 |
| WO | WO-2015143046 A2 | 9/2015 |
| WO | WO-2015153760 A2 | 10/2015 |
| WO | WO-2016164609 A2 | 10/2016 |
| WO | WO-2016172155 A1 | 10/2016 |
| WO | WO-2016188112 A1 | 12/2016 |
| WO | WO-2017048466 A1 | 3/2017 |
| WO | WO-2017075335 A1 | 5/2017 |
| WO | WO-2017075338 A2 | 5/2017 |
| WO | WO-2017106377 A1 | 6/2017 |
| WO | WO-2017151884 A1 | 9/2017 |
| WO | WO-2017180915 A2 | 10/2017 |
| WO | WO-2018049079 A1 | 3/2018 |
| WO | WO-2018126116 A1 | 7/2018 |
| WO | WO-2018148256 A1 | 8/2018 |
| WO | WO-2018187363 A1 | 10/2018 |
| WO | WO-2018213786 A1 | 11/2018 |
| WO | WO-2019109051 A1 | 6/2019 |
| WO | WO-2019224864 A1 | 11/2019 |
| WO | WO-2020243651 A1 | 12/2020 |

OTHER PUBLICATIONS

Aach et al. CasFinder: Flexible algorithm for identifying specific Cas9 targets in genomes. BioRxiv, Cold Spring Harbor Labs. Posted

(56) References Cited

OTHER PUBLICATIONS

May 12, 2014. doi: https://doi.org/10.1101/005074. Retrieved Sep. 10, 2020 at URL:https://doi.org/10.1101/005074. 8 pages.
Altschul, et al. Basic local alignment search tool. J Mol Biol. Oct. 5, 1990;215(3):403-410. doi: 10.1016/S0022-2836(05)80360-2.
Altschul, et al. Gapped BLAST and PSI-BLAST: a new generation of protein database search programs. Nucleic Acids Res. Sep. 1, 1997; 25(17):3389-3402. doi: 10.1093/nar/25.17.3389.
Anderson. Human gene therapy. Science. May 8, 1992;256(5058):808-13.doi: 10.1126/science.1589762.
Ayuso et al. Production, purification and characterization of adeno-associated vectors. Curr Gene Ther. Dec. 2010;10(6):423-36. doi: 10.2174/156652310793797685.
Bae et al. Cas-OFFinder: a fast and versatile algorithm that searches for potential off-target sites of Cas9 RNA-guided endonucleases. Bioinformatics, vol. 30, Issue 10, May 15, 2014, pp. 1473-1475, https://doi.org/10.1093/bioinformatics/btu048. Published online Jan. 24, 2014.
Bagot et al., Epigenetic signaling in psychiatric disorders: stress and depression, Dialogues Clin Neurosci., 16(3): 281-295 (2014).
Beerli, et al. Engineering polydactyl zinc-finger transcription factors. Nat Biotechnol. Feb. 2002;20(2):135-141. doi: 10.1038/nbt0202-135.
Beerli et al. Positive and negative regulation of endogenous genes by designed transcription factors. PNAS 97(4):1495-1500 (Feb. 15, 2000).
Bezzina et al., Early Onset of Hypersynchronous Network Activity and Expression of a Marker of Chronic Seizures in the Tg2576 Mouse Model of Alzheimer's Disease, PLoS ONE 10(3): e0119910 (14 pages) (2015).
Blouin et al. Improving rAAV production and purification: towards the definition of a scaleable process. J Gene Med. Feb. 2004;6 Suppl 1:S223-8.doi: 10.1002/jgm.505.
Büning et a. Recent developments in adeno-associated virus vector technology. J Gene Med. Jul. 2008;10(7):717-33.doi: 10.1002/jgm.1205.
Cermak, et al. Efficient design and assembly of custom TALEN and other TAL effector-based constructs for DNA targeting. Nucleic Acids Res. 39.12 (Jul. 2011): e82. doi: 10.1093/nar/gkr218. Epub Apr. 14, 2011.
Challis et al., Raphe GABAergic Neurons Mediate the Acquisition of Avoidance after Social Defeat, The Journal of Neuroscience, 33(35):13978-13988 (2013).
Cheah et al., Specific deletion of Nav1.1 sodium channels in inhibitory interneurons causes seizures and premature death in a mouse model of Dravet syndrome, Proc Natl Acad Sci, 109(36): 14646-14651 (2012).
Choo, et al. Advances in zinc finger engineering. Curr Opin Struct Biol. Aug. 2000;10(4):411-416. doi: 10.1016/s0959-440x(00)00107-x.
Colasante, et al. dCas9-Based Scn1a Gene Activation Restores Inhibitory Interneuron Excitability and Attenuates Seizures in Dravet Syndrome Mice. Mol Ther. Jan. 8, 2020;28(1):235-253. doi: 10.1016/j.ymthe.2019.08.018. Epub Sep. 3, 2019.
Connelly. Dravet Syndrome: Diagnosis and Long-Term Course. Can J Neurol Sci. 43: S3-S8 (2016).
Conway et al. Recombinant adeno-associated virus type 2 replication and packaging is entirely supported by a herpes simplex virus type 1 amplicon expressing Rep and Cap. J Virol. Nov. 1997; 71(11): 8780-8789.
CRISPR-Cas9 Epigenome Editing Screen Reveals Regulatory Elements. GenomeWeb. 3 pages. Apr. 3, 2017. Retrieved Nov. 6, 2018 at URL: https://www.genomeweb.com/epigenetics-research/crispr-cas9-epigenome-editing-screen-reveals-regulatory-elements?utm_source=Sailthru&utm_medium=email&utm_campaign=GWDN%20Tues%20AM%202017-04-04&utm_term=GW%20Daily%20News%20Bulletin#.W6XHxntKgdU.
Desjarlais et al., Use of a Zinc-Finger Consensus Sequence Framework and Specificity Rules to Design Specific DNA Binding Proteins. Proceedings of the National Academy of Sciences of the United States of America, 90.6 (Mar. 1993): 2256-2260.
Dillon. Regulating gene expression in gene therapy. Trends Biotechnol 11(5):167-173 (1993).
Dimidschstein et al. A viral strategy for targeting and manipulating interneurons across vertebrate species. Nat Neurosci. 19(12): 1743-1749 (Dec. 2016). doi: 10.1038/nn.4430.
Dingwall et al. The nucleoplasmin nuclear location sequence is larger and more complex than that of SV-40 large T antigen. J Cell Biol. Sep. 1, 1988; 107(3): 841-849.doi: 10.1083/jcb.107.3.841.
Doench et al. Optimized sgRNA design to maximize activity and minimize off-target effects of crisPr-cas9. Nature Biotechnology 34(2):184-191 (Feb. 2016). Advance Online Publication published online Jan. 18, 2016. doi: 10.1038/nbt/3437.
Ebi. Emboss Needle. Available at http://www.ebi.ac.uk/Tools/psa/emboss_needle/. Accessed on Dec. 20, 2016.
Eguchi, et al. Reprogramming cell fate with a genome-scale library of artificial transcription factors. Proc Natl Acad Sci USA. Dec. 20, 2016;113(51):E8257-E8266. doi: 10.1073/pnas.1611142114. Epub Dec. 5, 2016.
Embl-Ebi. Emboss Water Pairwise Sequence Alignment. Smith-Waterman algorithm. Accessed on Sep. 30, 2020. 2 pages. Available at https://www.ebi.ac.uk/Tools/psa/emboss_water.
Eriksen, et al. Progranulin: normal function and role in neurodegeneration. J Neurochem. Jan. 2008;104(2):287-97. Epub Oct. 22, 2007.
European search report and opinion dated Nov. 26, 2020 for EP Application No. 18781685.5.
Feng et al. Imaging Neuronal Subsets in Transgenic Mice Expressing Multiple Spectral Variants of GFP. Neuron 28:41-51 (Oct. 2000).
Frye et al., Neuropathological Mechanisms of Seizures in Autism Spectrum Disorder, Frontiers in Neuroscience, 10:192 (9 pages) (2016).
Geißler, et al. Transcriptional activators of human genes with programmable DNA-specificity. PLoS One. 2011;6(5):e19509. doi: 10.1371/journal.pone.0019509. Epub May 19, 2011.
GenBank Accession No. GCA_000001405.27 (replaced). RefSeq Accession: GCF_000001405.38 (replaced). GRCh38.p12. Date: Dec. 21, 2017. 3 pages. Retrieved Feb. 10, 2021 at URL: https://www.ncbi.nlm.nih.gov/assembly/GCF_000001405.38/.
GenBank Accession No. NC_000017. Version No. NC_000017.11. *Homo sapiens* chromosome 17, GRCh38.p13 Primary Assembly. Record created Aug. 29, 2002. 2 pages. Retrieved Feb. 10, 2021 at URL: https://www.ncbi.nlm.nih.gov/nuccore/NC_000017.
GenBank Accession No. NM_001032221. Version No. NM_001032221.3. *Homo sapiens* syntaxin binding protein 1 (STXBP1), transcript variant 2, mRNA. Record created Aug. 25, 2005. 5 pages. Retrieved Feb. 10, 2021 at URL: https://www.ncbi.nlm.nih.gov/nuccore/NM_001032221.3.
GenBank Accession No. NM_001037 XM_940055. Version No. NM_001037.4. *Homo sapiens* sodium voltage-gated channel beta subunit 1 (SCN1B), transcript variant a, mRNA. Record created Mar. 24, 1999. 4 pages. Retrieved Feb. 10, 2021 at URL: https://www.ncbi.nlm.nih.gov/nuccore/NM_001037.4.
GenBank Accession No. NM_001112741. Version No. NM_001112741.1. *Homo sapiens* potassium voltage-gated channel subfamily C member 1 (KCNC1), transcript variant 1, mRNA. Record created Dec. 20, 2007. 5 pages. Retrieved Feb. 10, 2021 at URL: https://www.ncbi.nlm.nih.gov/nuccore/NM_001112741.1.
GenBank Accession No. NM_001165963. Version No. NM_001165963.1. *Homo sapiens* sodium voltage-gated channel alpha subunit 1 (SCN1A), transcript variant 1, mRNA. Record created Oct. 1, 2009. 9 pages. Retrieved Feb. 10, 2021 at URL: https://www.ncbi.nlm.nih.gov/nuccore/NM_001165963.1.
GenBank Accession No. NM_002087. Version No. NM_002087.3. *Homo sapiens* granulin precursor (GRN), mRNA. Record created Mar. 24, 1999. 5 pages. Retrieved Feb. 10, 2021 at URL: https://www.ncbi.nlm.nih.gov/nuccore/NM_002087.3.
GenBank Accession No. NM_004588. Version No. NM_004588.4. *Homo sapiens* sodium voltage-gated channel beta subunit 2 (SCN2B), mRNA. Record created May 7, 1999. 5 pages. Retrieved Feb. 10, 2021 at URL: https://www.ncbi.nlm.nih.gov/nuccore/NM_004588.4.

(56) References Cited

OTHER PUBLICATIONS

GenBank Accession No. NM_004977. Version No. NM_004977.2. *Homo sapiens* potassium voltage-gated channel subfamily C member 3 (KCNC3), transcript variant 1, mRNA. Record created May 14, 1999. 5 pages. Retrieved Feb. 10, 2021 at URL: https://www.ncbi.nlm.nih.gov/nuccore/NM_004977.2.

GenBank Accession No. XM_005257253. Version No. XM_005257253.1. Predicted: *Homo sapiens* granulin precursor (GRN), transcript variant X1, mRNA. Record created Aug. 13, 2013. 2 pages. Retrieved Feb. 10, 2021 at URL: https://www.ncbi.nlm.nih.gov/nuccore/XM_005257253.1.

Genbank Accession No. AC007405. *Homo sapiens* BAC clone RP11-570C16 from 2, complete sequence. Washington University Genome Sequencing Center. Priority to at least Apr. 30, 2005.

Genome Reference Consortium Accession No. AL589692. Mouse DNA sequence from clone RP23-385C1 on chromosome 15, complete sequence. Wellcome Trust Sanger Institute. Submitted Dec. 13, 2012.

Gersbach et al. Synthetic Zinc Finger Proteins: The Advent of Targeted Gene Regulation and Genome Modification Technologies. Acc Chem Res. Aug. 19, 2014; 47(8): 2309-2318. Published online May 30, 2014. doi: 10.1021/ar500039w.

Ghidoni, et al. Circulating progranulin as a biomarker for neurodegenerative diseases. Am J Neurodegener Dis. 2012;1(2):180-90. Epub Aug. 2, 2012.

Gonzalez, et al. Modular system for the construction of zinc-finger libraries and proteins. Nat Protoc. Apr. 2010;5(4):791-810. doi: 10.1038/nprot.2010.34. Epub Apr. 1, 2010.

Gratz et al. Highly Specific and Efficient CRISPR/Cas9-Catalyzed Homology-Directed Repair in *Drosophila*. Genetics. Apr. 2014; 196(4): 961-971. Published online Jan. 29, 2014. doi: 10.1534/genetics.113.160713.

Gray et al., Optimizing Promoters for Recombinant Adeno-Associated Virus-Mediated Gene Expression in the Peripheral and Central Nervous System Using Self-Complementary Vectors, Human Gene Therapy, 22:1143-1153 (2011).

Grimm et al. Helper virus-free, optically controllable, and two-plasmid-based production of adeno-associated virus vectors of serotypes 1 to 6. Mol Ther. Jun. 2003;7(6):839-50. doi: 10.1016/s1525-0016(03)00095-9.

Haddada, et al. Gene therapy using adenovirus vectors. The Molecular Repertoire of Adenoviruses III. Curr Top Microbiol Immunol. 1995;199 (Pt 3):297-306. doi: 10.1007/978-3-642-79586-2_14.

Han et al., Autistic behavior in Scn1a+/− mice and rescue by enhanced GABAergic transmission, Nature, 489(7416): 385-390 (2012).

Han et al., Enhancement of Inhibitory Neurotransmission by GABAA Receptors Having α2,3-Subunits Ameliorates Behavioral Deficits in a Mouse Model of Autism, Neuron, 81(6): 1282-1289 (2014).

Hawkins et al. The synthetic neuroactive steroid SGE-516 reduces seizure burden and improves survival in a Dravet syndrome mouse model. Scientific Reports 7:15327. Published online Nov. 10, 2017. 8 pages. DOI:10.1038/s41598-017-15609-w.

Hedrich et al., Impaired Action Potential Initiation in GABAergic Interneurons Causes Hyperexcitable Networks in an Epileptic Mouse Model Carrying a Human Nav1.1 Mutation, The Journal of Neuroscience, 34(45): 14874-14889 (2014).

Heigwer et al. E-CRISP: fast CRISPR target site identification. Nat Methods. Feb. 2014;11(2):122-3. doi: 10.1038/nmeth.2812.

Hocquemiller et al. Adeno-Associated Virus-Based Gene Therapy for CNS Diseases. Human Gene Therapy 27(7):478-496 (2016).

International search report with written opinion dated Feb. 14, 2019 for PCT/US2018/063498.

International search report with written opinion dated Aug. 28, 2020 for PCT/US2020/035431.

Irizarry et al., Incidence of New-Onset Seizures in Mild to Moderate Alzheimer Disease, Arch Neurol., 69(3): 368-372 (2012).

Isalan, et al. A rapid, generally applicable method to engineer zinc fingers illustrated by targeting the HIV-1 promoter. Nat Biotechnol. Jul. 2001;19(7):656-660. doi: 10.1038/90264.

Karlin, et al. Applications and statistics for multiple high-scoring segments in molecular sequences. PNAS USA 90:5873-5877 (1993).

Karlin, et al. Applications and statistics for multiple high-scoring segments in molecular sequences. Proc Natl Acad Sci USA. Jun. 15, 1993; 90(12):5873-5877. doi: 10.1073/pnas.90.12.5873.

Karlin et al. Methods for assessing the statistical significance of molecular sequence features by using general scoring schemes. PNAS USA 87: 2264-2268 (1990).

Karlin, et al. Methods for assessing the statistical significance of molecular sequence features by using general scoring schemes. Proc Natl Acad Sci USA. Mar. 1990; 87(6): 2264-2268. doi: 10.1073/pnas.87.6.2264.

Khan et al. Computational tools and resources for prediction and analysis of gene regulatory regions in the chick genome. Genesis 51(5):311-324 (May 2013).

Kovacs et al., Alzheimer's secretases regulate voltage-gated sodium channels, Neurosci Lett., 486(2): 68-72 (2010).

Kremer et al. Adenovirus and adeno-associated virus mediated gene transfer. Br Med Bull. 51(1):31-44 (1995).

Kurien, et al. A brief review of other notable protein detection methods on acrylamide gels. Methods Mol Biol. 2012;869:617-620. doi: 10.1007/978-1-61779-821-4_56.

Lambert et al. The Human Transcription Factors. Cell 172:650-665 (Feb. 8, 2018).

Ledri et al. Global Optogenetic Activation of Inhibitory Interneurons during Epileptiform Activity. Journal of Neuroscience 34(9):3364-3377 (Feb. 26, 2014). DOI: https://doi.org/10.1523/JNEUROSCI.2734-13.2014.

Lee et al. Transcriptional Regulation and its Misregulation in Disease. Cell 152(6):1237-1251. doi: 10.1016/j.cell.2013.02.014.

Lee et al. The Largest Group of Superficial Neocortical GABAergic Interneurons Expresses Ionotropic Serotonin Receptors. Journal of Neuroscience 30(50):16796-16808 (Dec. 15, 2010). DOI: https://doi.org/10.1523/JNEUROSCI.1869-10.2010.

Li et al. Modularly assembled designer TAL effector nucleases for targeted gene knockout and gene replacement in eukaryotes. Nucleic Acids Res. Aug. 2011; 39(14): 6315-6325. Published online Mar. 31, 2011. doi: 10.1093/nar/gkr188.

Liu, et al. CRISPR-ERA: a comprehensive design tool for CRISPR-mediated gene editing, repression and activation. Bioinformatics. 31 (22). 2015. pp. 3676-3678.

Liu et al. Design of polydactyl zinc-finger proteins for unique addressing within complex genomes. Proc Natl Acad Sci U S A. May 27, 1997;94(11):5525-30. doi: 10.1073/pnas.94.11.5525.

Lock et al. Absolute determination of single-stranded and self-complementary adeno-associated viral vector genome titers by droplet digital PCR. Hum Gene Ther Methods 25(2):115-125 (2014).

Lock et al. Characterization of a recombinant adeno-associated virus type 2 Reference Standard Material. Hum Gene Ther. Oct. 2010;21(10):1273-85. doi: 10.1089/hum.2009.223.

Ma, et al. A guide RNA sequence design platform for the CRISPR/Cas9 system for model organism genomes. Biomed Res Int. 2013;2013:270805. doi: 10.1155/2013/270805. Epub Oct. 3, 2013. 4 pages.

Maguire et al. Gene Therapy for the Nervous System: Challenges and New Strategies. Neurotherapeutics 11:817-839 (Aug. 27, 2014). DOI: 10.1007/s13311-014-0299-5.

Makkerh, et al. Comparative mutagenesis of nuclear localization signals reveals the importance of neutral and acidic amino acids. Curr Biol. Aug. 1, 1996;6(8):1025-1027. doi: 10.1016/s0960-9822(02)00648-6.

Mandell, et al. Zinc Finger Tools: custom DNA-binding domains for transcription factors and nucleases. Nucleic Acids Res. Jul. 1, 2006;34(Web Server issue):W516-W523. doi: 10.1093/nar/gkl209.

Marini et al. The genetics of Dravet syndrome. Epilepsia 52(Suppl. 2):24-29 (2011).

McLean et al., Widespread neuron-specific transgene expression in brain and spinalcord following synapsin promoter-driven AAV9 neonatalintracerebroventricular injection, Neuroscience Letters, 576: 73-78 (2014).

Meyer et al. In vivo labeling of parvalbumin-positive interneurons and analysis of electrical coupling in identified neurons. J Neurosci 22(16):7055-7064 (Aug. 15, 2002).

(56) References Cited

OTHER PUBLICATIONS

Miller, et al. From Gene Replacement to Gene Regulation: Developing a Disease-Modifying AAV Gene Therapy Vector for SCN1A-Positive (SCN1A+) Pediatric Epilepsy. American Epilepsy Association Annual Meeting Abstracts. Abstract 1.091. Published Nov. 2019. (online journal) Retrieved from the internet on Feb. 10, 2021. URL: https://www.aesnet.org/meetings_events/annual_meeting_abstracts/view/2421087.

Miller et al. Mapping genetic modifiers of survival in a mouse model of Dravet syndrome. Genes, Brain and Behavior 13:163-172 (Feb. 2014). First published Oct. 23, 2013. doi: 10.1111/gbb.12099.

Miller. Human gene therapy comes of age. Nature 357:455-460 (1992).

Mitani et al. Delivering therapeutic genes—matching approach and application Trends Biotechnol 11:162-166 (1993).

Mo et al. Epigenomic Signatures of Neuronal Diversity in the Mammalian Brain. Neuron 86:1369-1384 (Jun. 17, 2015).

Mo et al. Supplemental Information: Epigenomic Signatures of Neuronal Diversity in the Mammalian Brain. Neuron 86(6) (Jun. 17, 2015). 30 pages.

Montague et al. ChopChop: a CRISPR/Cas9 and TALEN web tool for genome editing. Nucleic Acids Res. Jul. 1, 2014; 42(Web Server issue): W401-W407. Published online May 26, 2014. doi: 10.1093/nar/gku410.

Morbitzer et al. Assembly of custom TALE-type DNA binding domains by modular cloning. Nucleic Acids Res. Jul. 2011; 39(13): 5790-5799. Published online Mar. 18, 2011. doi: 10.1093/nar/gkr151.

Nabel, et al. Direct gene transfer for immunotherapy and immunization. Trends Biotechnol. May 1993;11(5):211-215. doi: 10.1016/0167-7799(93)90117-R.

Narlikar et al. Identifying regulatory elements in eukaryotic genomes. Briefings in Functional Genomics and Proteomics 8(4):215-230 (Jun. 4, 2009).

Nathanson et al., Short promoters in viral vectors drive selective expression in mammalian inhibitory neurons, but do not restrict activity to specific inhibitory cell-types, Frontiers in Neural Circuits, 3(19): 1-24 (2009).

NCBI. Basic Local Alignment Search Tool. BLAST algorithm. Available at https://blast.ncbi.nlm.nih.gov/Blast.cgi. Accessed on Jan. 3, 2017.

Nguyen, et al. Progranulin: at the interface of neurodegenerative and metabolic diseases. Trends Endocrinol Metab. Dec. 2013;24(12):597-606. doi: 10.1016/j.tem.2013.08.003. Epub Sep. 10, 2013.

Niels Van Tol et al. Artificial transcription factor-mediated regulation of gene expression. Plant Science 225:58-67 (2014).

Oakley, et al. Temperature- and age-dependent seizures in a mouse model of severe myoclonic epilepsy in infancy. Proc Natl Acad Sci USA. Mar. 10, 2009;106(10):3994-9. doi: 10.1073/pnas.0813330106. Epub Feb. 20, 2009.

Ogiwara et al., Nav1.1 haploinsufficiency in excitatory neurons ameliorates seizure-associated sudden death in a mouse model of Dravet syndrome, Human Molecular Genetics, 22(23): 4784-4804 (2013).

Ogiwara et al. Nav1.1 Localizes to Axons of Parvalbumin-Positive Inhibitory Interneurons: A Circuit Basis for Epileptic Seizures in Mice Carrying an Scn1a Gene Mutation. The Journal of Neuroscience 27(22):5903-5914 (May 30, 2007).

Oliva JR. et al. Novel Hippocampal Interneuronal Subtypes Identified Using Transgenic Mice That Express Green Fluorescent Protein in GABAergic Interneurons. The Journal of Neuroscience 20(9):3354-3368 (May 1, 2000).

Onori et al. UtroUp is a novel six zinc finger artificial transcription factor that recognises 18 base pairs of the utrophin promoter and efficiently drives utrophin upregulation. BMC Molecular Biology 14:3 (2013). 9 pages.

Pabo, et al. Design and selection of novel Cys2His2 zinc finger proteins. Annu Rev Biochem. 2001;70:313-340. doi: 10.1146/annurev.biochem.70.1.313.

Palop et al., Aberrant Excitatory Neuronal Activity and CompensatoryRemodelingof InhibitoryHippocampal Circuits in MouseModels of Alzheimer's Disease, Neuron, 55: 697-711 (2007).

Palop et al., Epilepsy and Cognitive Impairments in Alzheimer Disease, Arch Neurol., 66(4): 435 (11 pages) (2009).

Papworth et al. Designer zinc-finger proteins and their applications. Gene 366:27-38 (2006).

PCT/US2018/025940 International Search Report and Written Opinion dated Aug. 23, 2018.

Pelkey et al. Hippocampal GABAergic Inhibitory Interneurons. Physiol Rev 97(4):1619-1747 (Oct. 1, 2017). DOI: 10.1152/physrev.00007.2017.

Puts et al., Reduced GABA and Altered Somatosensory Function in Children with Autism Spectrum Disorder, Autism Res., 10(4): 608-619 (2017).

PVALB (main page). The Human Protein Atlas. Available at https://www.proteinatlas.org/ENSG00000100362-PVALB/tissue. Accessed on Sep. 27, 2018.

Radde et al. Aβ42-driven cerebral amyloidosis in transgenic mice reveals early and robust pathology. EMBO reports 7(9):940-946 (Sep. 1, 2006). Published online Aug. 11, 2006. DOI 10.1038/sj.embor.7400784.

Ran et al. In vivo genome editing using *Staphylococcus aureus* Cas9.Nature. Apr. 9, 2015; 520(7546): 186-191. Published online Apr. 1, 2015. doi: 10.1038/nature14299.

Ray et al. Quantitative tracking of protein trafficking to the nucleus using cytosolic protein delivery by nanoparticle-stabilized nanocapsules. Bioconjug Chem. Jun. 17, 2015; 26(6): 1004-1007. Published online Jun. 2, 2015. doi: 10.1021/acs.bioconjchem.5b00141.

Reetz et al., Development of Adenoviral Delivery Systems to Target Hepatic Stellate Cells In Vivo, PLoS ONE 8(6): e67091, 14 pages (2013).

Ritter et al., Lentiviral expression of GAD67 and CCK promoterdriven opsins to target interneurons in vitro and in vivo, J Gene Med, 18: 27-37 (2016).

Sander, et al. Zinc Finger Targeter (ZiFiT): an engineered zinc finger/target site design tool. Nucleic Acids Res. Jul. 2007;35(Web Server issue):W599-W605. doi: 10.1093/nar/gkm349. Epub May 25, 2007.

Schleef et al. The structure of the mouse parvalbumin gene. Mammalian Genome 3:217-225 (1992).

Scott et al. Targeted genome regulation and modification using transcription activator-like effectors. FEBS Journal 281:4583-4597 (2014). doi: 10.1111/febs.12973.

Segal, et al. Custom DNA-binding proteins come of age: polydactyl zinc-finger proteins. Curr Opin Biotechnol. Dec. 2001;12(6):632-637. doi: 10.1016/s0958-1669(01)00272-5.

Shevtsova et al., Promoters and serotypes: targeting of adeno-associated virus vectors for gene transfer in the rat central nervous system in vitro and in vivo, Exp Physiol 90.1 pp. 53-59 (2004).

Snowden, et al. Progranulin gene mutations associated with frontotemporal dementia and progressive non-fluent aphasia. Brain. Nov. 2006;129(Pt 11):3091-102. Epub Sep. 26, 2006.

Sohn et al., A Single Vector Platform for High-Level Gene Transduction of Central Neurons: Adeno-Associated Virus Vector Equipped with the Tet-Off System, PLoS ONE 12(1): e0169611, 22 pages, (2017).

Soukupova et al., Impairment of GABA release in the hippocampus at the time of the first spontaneous seizure in the pilocarpine model of temporal lobe epilepsy, Experimental Neurology, 257: 39-49 (2014).

Strimpakos et al. Novel Adeno-Associated Viral Vector Delivering the Utrophin Gene Regulator Jazz Counteracts Dystrophic Pathology in mdx Mice. J Cell Physiol 229:1283-1291 (2014).

Sun et al., SCN1A, SCN1B, and GABRG2 gene mutation analysis in Chinese families with generalized epilepsy with febrile seizures plus, J Hum Genet, 53:769-774 (2008).

Tai et al., Impaired excitability of somatostatin- and parvalbumin-expressing cortical interneurons in a mouse model of Dravet Syndrome, Proc Natl Acad Sci, 111(30): E3139-3148 (2014).

Tamamaki et al. Green flourescent protein expression and colocalization with calretinin, parvalbumin, and somatostatin in the GAD67-GFP knock-in mouse. J Comp Neurol 467(1):60-79 (Dec. 1, 2003).

(56) References Cited

OTHER PUBLICATIONS

Taniguchi et al., A Resource of Cre Driver Lines for Genetic Targeting of GABAergic Neurons in Cerebral Cortex, Neuron, 71: 995-1013 (2011).
Taniguchi, Genetic dissection of GABAergic neural circuits in mouse neocortex. Front Cell Neurosci vol. 8, Article 8 (Jan. 27, 2014). 22 pages. DOI: .https://doi.org/10.3389/fncel.2014.00008.
Uil et al. Therapeutic modulation of endogenous genefunction by agents with designed DNA-sequence specificities. Nucleic Acids Research 31(21):6064-6078 (2003). DOI: 10.1093/nar/gkg815.
Urabe et al. Insect cells as a factory to produce adeno-associated virus type 2 vectors.Hum Gene Ther. Nov. 1, 2002;13(16):1935-43.doi: 10.1089/10430340260355347.
U.S. Appl. No. 16/153,401 Notice of Allowance dated Feb. 21, 2019.
U.S. Appl. No. 16/153,401 Office Action dated Jan. 11, 2019.
U.S. Appl. No. 16/153,420 Notice of Allowance dated Feb. 21, 2019.
U.S. Appl. No. 16/153,420 Office Action dated Dec. 14, 2018.
U.S. Appl. No. 16/153,433 Notice of Allowance dated Oct. 11, 2019.
U.S. Appl. No. 16/153,433 Office Action dated Dec. 31, 2018.
U.S. Appl. No. 16/153,433 Office Action dated Jul. 1, 2019.
U.S. Appl. No. 16/153,443 Office Action dated Jan. 11, 2019.
U.S. Appl. No. 16/153,443 Office Action dated Jul. 29, 2019.
U.S. Appl. No. 16/153,443 Office Action dated Mar. 5, 2020.
Van Brunt. Molecular Farming: Transgenic Animals as Bioreactors. Biotechnology (NY). 1988;6(10):1149-1154. doi: 10.1038/nbt1088-1149.
Van Den Pol et al. Selective neuronal expression of green fluorescent protein with cytomegalovirus promoter reveals entire neuronal arbor in transgenic mice. J Neurosci 18(24):10640-10651 (Dec. 15, 1998).
Verret et al., Inhibitory Interneuron Deficit Links Altered Network Activity and Cognitive Dysfunction in Alzheimer Model, Cell, 149(3): 708-721 (2012).
Vigne et al. Third-generation adenovectors for gene therapy. Restor Neurol Neurosci 8(1):35-36 (1995).
Weber, et al. Assembly of Designer TAL Effectors by Golden Gate Cloning, PLoS ONE, 6:e19722 (2001).
Wootton, et al. Statistics of local complexity in amino acid sequences and sequence databases. Computers & Chemistry. Jun. 1993; 17(2): 149-163. doi: 10.1016/0097-8485(93)85006-X.
Wright et al. Standardized reagents and protocols for engineering zinc finger nucleases by modular assembly.Nat Protoc. 2006;1(3):1637-52.doi: 10.1038/nprot.2006.259.
Wu et al. Target specificity of the CRISPR-Cas9 system. Quantitative Biology, vol. 2, pp. 59-70 (2014). Published: Aug. 26, 2014. DOI 10.1007/s40484-014-0030-x.
Xiao et al. CasOT: a genome-wide Cas9/gRNA off-target searching tool. Bioinformatics. Apr. 15, 2014;30(8):1180-1182.
Xiao, et al. Production of high-titer recombinant adeno-associated virus vectors in the absence of helper adenovirus. J Virol. Mar. 1998;72(3):2224-2232.
Xie et al., MicroRNA-regulated, Systemically Delivered rAAV9: A Step Closer to CNS-restricted Transgene Expression, Mol Ther., 19(3):526-535 (2011).
Xu et al. Immunochemical characterization of inhibitory mouse cortical neurons: Three chemically distinct classes of inhibitory cells. J Comp Neurol 518(3):389-404 (Feb. 1, 2010). doi: 10.1002/cne.22229.
Yan et al., Targeting the β secretase BACE1 for Alzheimer's disease therapy, Lancet Neurol., 13(3): 319-329 (2014).
Young et al. 915—a GABA-Selective AAV Vector-Based Approach to Up-Regulate Endogenous Scn1a Expression reverses key Phenotypes in a Mouse Model of Dravet Syndrome. 22nd Annual Meeting American Society of Gene & Cell Therapy. Washington, D.C. Apr. 29-May 2, 2019 (Abstract).
Young, et al. A GABA-Selective AAV Vector Upregulates Endogenous SCN1A Expression and Reverses Multiple Phenotypes in a Mouse Model of Dravet Syndrome. American Epilepsy Association Annual Meeting Abstracts. Abstract 3.1. Published Nov. 2019. (online journal) Retrieved from the Internet on Feb. 10, 2021. URL: https://www.aesnet.org/meetings_events/annual_meeting_abstracts/view/2421999.
Yu et al. Progress towards gene therapy for HIV infection. Gene Ther 1(1):13-26 (1994).
Yu, et al. The spectrum of mutations in progranulin: a collaborative study screening 545 cases of neurodegeneration. Arch Neurol. Feb. 2010;67(2):161-70. doi: 10.1001/archneurol.2009.328.
Zetsche, et al. Cpf1 is a single RNA-guided endonuclease of a class 2 CRISPR-Cas system. Cell. Oct. 22, 2015;163(3):759-771. doi: 10.1016/j.cell.2015.09.038. Epub Sep. 25, 2015.
Zhang et al. Efficient construction of sequence-specific TAL effectors for modulating mammalian transcription. Nature Biotechnology vol. 29, pp. 149-153 (Jan. 19, 2011).
Zuris et al., Efficient Delivery of Genome-Editing Proteins In Vitro and In Vivo, Nat Biotechnol., 33(1): 73-80 (Jan. 2015).
Bae et al.: Human zinc fingers as building blocks in the construction of artificial transcription factors. Nat Biotechnol. 21(3):275-280 doi:10.1038/nbt796 (2003).
U.S. Appl. No. 16/670,996 Non-Final Office Action dated Dec. 8, 2021.
U.S. Appl. No. 16/670,996 Final Office Action dated Jun. 17, 2022.
Hsiao, J. et al., "Upregulation of Haploinsufficient Gene Expression in the Brain by Targeting a Long Non-coding RNA Improves Seizure Phenotype in a Model of Dravet Syndrome," EBioMedicine, 2016, vol. 9, pp. 257-277.
Fenzi Shengwuxue: Chapter 5 Protein Structure and Functions—Transcriptional Factors. Molecular Biology, Ed. Yu Duowei, Gong Zhunan, Liu Ping—Nanjing: Nanjing Normal University Press, College Teaching Materials, pp. 100-107 [English Translation provided] (2007).
Li et al.: The zinc-sensing mechanism of mouse MTF-1 involves linker peptides between the zinc fingers. Mol Cell Biol. 26(15):5580-5587 doi:10.1128/MCB.00471-06 (2006).
Keaveney et al. A MicroRNA-Based Gene-Targeting Tool for Virally Labeling Interneurons in the Rodent Cortex. Cell Rep 24(2): 294-303 (Jul. 10, 2018).
Sahenk et al. Systemic delivery of AAVrh74.tMCK.hCAPN3 rescues the phenotype in a mouse model for LGMD2A/R1. Mol Ther Methods Clin Dev 22:401-414 (2021).
Sayeg et al. Rationally Designed MicroRNA-Based Genetic Classifiers Target Specific Neurons in the Brain. ACS Synth Biol 4(7):788-795 (Apr. 7, 2015).
Heilbronn, et al. Viral vectors for gene transfer: current status of gene therapeutics. Handb Exp Pharmacol. 2010;(197):143-170. doi: 10.1007/978-3-642-00477-3_5.
Bender et al.: SCN1A mutations in Dravet syndrome: impact of interneuron dysfunction on neural networks and cognitive outcome. Epilepsy Behav. 3(3):177-186 doi:10.1016/j.yebeh.2011.11.022 (2012).
Hossain et al.: Artificial zinc finger DNA binding domains: versatile tools for genome engineering and modulation of gene expression. J Cell Biochem. 116(11):2435-2444 doi:10.1002/jcb.25226 (2015).
Choi et al., A Generic Intron Increases Gene Expression in Transgenic Mice. Mol. Cell. Biol., 11(6):3070-3074 (1991).
Definition of Eukaryotic Expression Cassette (2023).
EP18803184.3 Partial Supplementary European Search Report dated Feb. 22, 2021.
EP18803184.3 Supplementary European Search Report dated May 26, 2021.
European Application No. 18803184 Search Report dated Feb. 22, 2021.
Furger et al.: Promoter proximal splice sites enhance transcription. Genes Dev.16(21):2792-2799 doi:10.1101/gad.983602 (2002).
GenBank Accession: AAA52484 factor (1994).
GenBank Accession: K01740.1 Human coagulation factor (1994).
Le et al.: Classifying Promoters by Interpreting the Hidden Information of DNA Sequences via Deep Learning and Combination of Continuous FastText N-Grams. Front Bioeng Biotechnol. 7:305:1-9 doi: 10.3389/fbioe.2019.00305 (2019).
Li et al., A small regulatory element from chromosome 19 enhances liver-specific gene expression. Gene Therapy 16:43-51 (2009).

(56) References Cited

OTHER PUBLICATIONS

McIntosh et al., Therapeutic levels of FVIII following a single peripheral vein administration of rAAV vector encoding a novel human factor VIII variant. Blood 121(17):3335-3344 (2013).

Morello et al.: Testing the IMEter on rice introns and other aspects of intron-mediated enhancement of gene expression. J Exp Bot. 62(2):533-544 doi:10.1093/jxb/erq273 (2011).

Ostedgaard et al., A shortened adeno-associated virus expression cassette for CFTR gene transfer to cystic fibrosis airway epithelia. PNAS UA 102(8):2952-2957 (2005).

PCT/US2018/033515 International Preliminary Report on Patentability dated Nov. 28, 2019.

PCT/US2018/033515 International Search Report and Written Opinion dated Oct. 22, 2018.

PCT/US2018/063498 International Preliminary Report on Patentability dated Jun. 11, 2020.

Rose Intron-mediated regulation of gene expression. Curr Top Microbiol Immunol., 326:277-290 (2008).

Sakharkar et al.: Distributions of exons and introns in the human genome. In Silico Biol. 4(4):387-393 (2004).

Samadder et al.: Transcriptional and post-transcriptional enhancement of gene expression by the 5' UTR intron of rice rubi3 gene in transgenic rice cells. Mol Genet Genomics. 279(4):429-439 doi:10.1007/s00438-008-0323-8 (2008).

SEQ ID 1 and 2 sequence alignment (2023).

Sequence alignment for exemplar sequences SEQ ID No. 1, 2, 13 and 22 (2023).

Shaul: How introns enhance gene expression. Int J Biochem Cell Biol. 91(Pt B): 145-155 doi:10.1016/j.biocel.2017.06.016 (2017).

U.S. Appl. No. 16/687,426 Office Action dated Jul. 6, 2022.

U.S. Appl. No. 16/687,426 Office Action dated Mar. 27, 2023.

U.S. Appl. No. 16/687,426 Office Action dated Nov. 22, 2022.

U.S. Appl. No. 16/687,426 Office Action dated Nov. 3, 2023.

Willyard: New human gene tally reignites debate. Nature. 558(7710):354-355 doi:10.1038/d41586-018-05462-w (2018).

Wu et al., Optimization of Self-complementary AAV Vectors for Liver-directed Expression Results in Sustained Correction of Hemophilia B at Low Vector Dose, Molecular Therapy, 16(2): 280-289 (2008).

Yan et al. Optimization of Recombinant Adeno-Associated Virus-Mediated Expression for Large Transgenes, Using a Synthetic Promoter and Tandem Array Enhancers. Human Gene Therapy 26:334-346 (Jun. 2015). DOI: 10.1089/hum.2015.001.

* cited by examiner reporter alone

SEQ ID NO: 51

SEQ ID NO: 1

SEQ ID NO: 2

SEQ ID NO: 3

SEQ ID NO: 4

Reporter alone

SEQ ID: 50

SEQ ID: 51

SEQ ID: 52

SEQ ID: 53

## ENGINEERED DNA BINDING PROTEINS

CROSS-REFERENCE

This application is a continuation application of International Patent Application No. PCT/US2018/63498, filed Nov. 30, 2018, which claims the benefit of U.S. Provisional Patent Application No. 62/593,824, filed Dec. 1, 2017; U.S. Provisional Patent Application No. 62/610,014, filed Dec. 22, 2017; U.S. Provisional Patent Application No. 62/646,198, filed Mar. 21, 2018; U.S. Provisional Patent Application No. 62/618,966, filed Jan. 18, 2018; U.S. Provisional Patent Application No. 62/641,806, filed Mar. 12, 2018; U.S. Provisional Patent Application No. 62/664,814, filed Apr. 30, 2018; and U.S. Provisional Patent Application No. 62/664,817, filed Apr. 30, 2018, each of which is incorporated herein by reference in its entirety.

SEQUENCE LISTING

The instant application contains a Sequence Listing which has been submitted electronically in ASCII format and is hereby incorporated by reference in its entirety. Said ASCII copy, created on Nov. 30, 2018, is named 46482-711_601_SL.txt and is 864,453 bytes in size.

BACKGROUND

A broad range of human diseases are associated with abnormal expression of genes. In some cases, a genetic mutation in a gene causes it to be dysregulated, downregulated, or not expressed at all, resulting in haploinsufficiency. In some cases, a genetic mutation in a gene causes it to be upregulated, resulting in overexpression of the gene. Many challenges exist in treating genetic disorders or diseases. One approach is gene therapy, which involves therapeutic delivery of a nucleic acid into a patient's cell. However, various challenges associated with gene therapy remain unsolved, such as unwanted immune response elicited by gene therapy, off-target effects, limitations on cloning capacity of gene therapy vehicles (e.g., viruses), sustaining the therapeutic effect over a longer period of time, etc. The central nervous system (CNS) poses many unique challenges for the development of a therapy that addresses the underlying impairment in a gene and/or protein expression. While there are drugs that help to manage symptoms of CNS diseases/disorders, many CNS diseases/disorders, e.g, Dravet syndrome or frontotemporal dementia, lack specific treatments or a cure. Thus, there is a need for novel compositions and methods capable of modulating the expression of any endogenous gene to help reverse the effects of a disease or disorder, in particular, a therapy with reduced immunogenicity, reduced off-target effects, increased specificity for a target gene, and/or increased therapeutic efficacy.

SUMMARY

In one aspect, the application provides an expression cassette, comprising a sequence encoding a non-naturally occurring transcription factor which increases expression of the SCN1A gene in a cell. In certain embodiments, the transcription factor which increases expression of SCN1A binds to a target site that is capable of increasing SCN1A expression by at least 20% in a transcriptional activation assay. In certain embodiments, the transcription factor which increases expression of SCN1A is capable of reducing the seizure frequency in a mouse model of Dravet syndrome by at least 20% in a hyperthermic seizure assay. In certain embodiments, the transcription factor which increases expression of SCN1A binds to a target site that is capable of increasing SCN1A expression by at least 20% in a transcriptional activation assay and the transcription factor is capable of reducing the seizure frequency in a mouse model of Dravet syndrome by at least 20% in a hyperthermic seizure assay.

In certain embodiments, the transcription factor which increases expression of SCN1A binds to a genomic location on chromosome 2. In certain embodiments, the transcription factor which increases expression of SCN1A binds to a genomic location on chromosome 2 that is within 110 kb upstream or downstream of the transcriptional start site of the SCN1A gene. In certain embodiments, the transcription factor which increases expression of SCN1A binds to a genomic location on chromosome 2 that is within positions 166179652-165989571 (with reference to GRCh38.p12). In certain embodiments, the transcription factor which increases expression of SCN1A binds to a genomic location on chromosome 2 that is within positions 166128050-166127958 (with reference to GRCh38.p12). In certain embodiments, the transcription factor which increases expression of SCN1A binds to a genomic location on chromosome 2 that is within positions 166155414-166140590 (with reference to GRCh38.p12). In certain embodiments, the transcription factor which increases expression of SCN1A binds to a genomic location on chromosome 2 that is within positions 166179652-1661777272 (with reference to GRCh38.p12). In certain embodiments, the transcription factor which increases expression of SCN1A binds to a genomic location on chromosome 2 that is within positions 1659990246-165989592 (with reference to GRCh38.p12). In certain embodiments, the transcription factor which increases expression of SCN1A binds to a genomic region within 200 bp of a genomic location having a sequence of any one of SEQ ID NOs: 35-37, 105-111, 136, 195-211, 224-238, 240-267. In certain embodiments, the transcription factor which increases expression of SCN1A binds to a genomic region that is at least partially overlapping with a genomic location having a sequence of any one of SEQ ID NOs: 35-37, 105-111, 136, 195-211, 224-238, 240-267. In certain embodiments, the transcription factor which increases expression of SCN1A binds to a genomic region having a sequence of any one of SEQ ID NOs: 35-37, 105-111, 136, 195-211, 224-238, 240-267. In certain embodiments, the transcription factor which increases expression of SCN1A binds to a genomic region having 18-27 nucleotides (e.g., at least 12, 13, 14, 15, 16, 17, 18, 19, 20, 21, 22, 23, 24, 25, 26, 27, 28, 29, or 30 nucleotides).

In certain embodiments, the transcription factor which increases expression of SCN1A comprises a DNA binding domain. In certain embodiments, the transcription factor which increases expression of SCN1A comprises a DNA binding domain and a transcription activating domain. In certain embodiments, the DNA binding domain comprises at least 80% sequence identity to its closest human counterpart. In certain embodiments, the DNA binding domain comprises at least 90% sequence identity to its closest human counterpart. In certain embodiments, the DNA binding domain and the transcription activating domain both comprise at least 80% sequence identity to their closest human counterparts. In certain embodiments, the DNA binding domain and the transcription activating domain both comprise at least 90% sequence identity to their closest human counterparts. In certain embodiments, the DNA binding domain comprises a guide RNA and a nuclease inactivated Cas protein. In certain embodiments, the nuclease inactivated Cas protein is a nuclease inactivated Cas9. In certain embodiments, the DNA binding domain comprises a zinc finger domain. In certain embodiments, the DNA binding domain comprises six to nine zinc finger domains. In certain embodiments, the DNA binding domain comprises six zinc fingers. In certain embodiments, the DNA binding domain comprising six fingers binds to a genomic region having 18 nucleotides. In certain embodiments, the DNA binding domain comprises nine zinc fingers. In certain embodiments, the DNA binding domain comprising nine zinc fingers binds to a genomic region having 27 nucleotides. In certain embodiments, the DNA binding domain comprises a sequence having at least 95% sequence identity to any of SEQ ID NOs: 135, 371, 372 or 376. In certain embodiments, the DNA binding domain comprises a sequence having any one of SEQ ID NOs: 135, 371, 372 or 376. In certain embodiments, the DNA binding domain is derived from human EGR1 or human EGR3. In certain embodiments, the transcription activating domain comprises a VPR, VP64, CITED2 or CITED4 sequence, or a functional fragment thereof. In certain embodiments, the transcription activating domain comprises a human CITED2 or CITED4 sequence, or a functional fragment thereof.

In certain embodiments, the expression cassette encoding a transcription factor which increases expression of SCN1A further comprises a regulatory element that drives expression of the transcription factor at a higher level in PV neurons than in other cell types. In certain embodiments, the regulatory element comprises a sequence having any one of SEQ ID NOs: 183, 184, 185, or 417. In certain embodiments, the regulatory element comprises a sequence having SEQ ID NO: 183 or 185.

In certain embodiments, the expression cassette encoding a transcription factor which increases expression of SCN1A is a part of a viral vector. In certain embodiments, the viral vector is an AAV virus. In certain embodiments, the AAV virus is an AAV9 virus or a scAAV9 virus.

In another aspect, the application provides a method of increasing expression of SCN1A in a cell by administering any of expression cassette described herein that encode a transcription factor which increases expression of SCN1A. In certain embodiments, the cell is a PV neuron. In certain embodiments, the cell is within a subject. In certain embodiments, the subject is a mammal. In certain embodiments, the subject is a human. In certain embodiments, increasing expression of SCN1A treats a disease, disorder or symptom. In certain embodiments, the disorder is a central nervous system disorder. In certain embodiments, the disorder is Dravet Syndrome. In certain embodiments, the central nervous system disorder is neuronal hyperactivity. In certain embodiments, treating the central nervous system disorder comprises reducing neuronal hyperactivity. In certain embodiments, a symptom of the central nervous system disorder is seizures. In certain embodiments, treating the central nervous system disorder comprises reducing the frequency of seizures. In certain embodiments, treating the central nervous system disorder comprises reducing the severity of seizures. In certain embodiments, treating the central nervous system disorder comprises reducing the severity and frequency of seizures.

In another aspect, the application provides an expression cassette, comprising a sequence encoding a non-naturally occurring transcription factor which increases expression of the GRN gene in a cell.

In certain embodiments, the transcription factor which increases expression of GRN binds to a genomic region having 18-27 nucleotides.

In certain embodiments, the transcription factor which increases expression of GRN comprises a DNA binding domain. In certain embodiments, the transcription factor which increases expression of GRN comprises a DNA binding domain and a transcription activating domain. In certain embodiments, the DNA binding domain comprises a guide RNA and a nuclease inactivated Cas protein. In certain embodiments, the nuclease inactivated Cas protein is a nuclease inactivated Cas9. In certain embodiments, the DNA binding domain comprises a zinc finger domain. In certain embodiments, the DNA binding domain comprises six to nine zinc finger domains. In certain embodiments, the DNA binding domain comprises six zinc fingers. In certain embodiments, the DNA binding domain comprising six zinc fingers binds to a genomic region having 18 nucleotides. In certain embodiments, the DNA binding domain comprises nine zinc fingers. In certain embodiments, the DNA binding domain comprising nine zinc fingers binds to a genomic region having 27 nucleotides. In certain embodiments, the DNA binding domain comprises a sequence having at least 95% sequence identity to any of SEQ ID NOs: 171 or 412-416. In certain embodiments, the DNA binding domain comprises a sequence having any one of SEQ ID NOs: 171 or 412-416. In certain embodiments, the DNA binding domain is derived from human EGR1 or human EGR3. In certain embodiments, the transcription activating domain comprises a VPR, VP64, CITED2 or CITED4 sequence, or a functional fragment thereof.

In certain embodiments, the expression cassette encoding a transcription factor which increases expression of GRN further comprises a regulatory element that drives expression of the non-naturally occurring transcriptional modulator. In certain embodiments, the regulatory element is a cell type selective regulatory element.

In certain embodiments, the expression cassette encoding a transcription factor that increases expression of GRN is a part of a viral vector. In certain embodiments, the viral vector is an AAV virus. In certain embodiments, the AAV virus is an AAV9 virus or a scAAV9 virus.

In another aspect, the application provides a method of increasing expression of GRN in a cell by administering any of the expression cassette described herein that encode a transcription factor that increases expression of GRN. In certain embodiments, increasing expression of GRN treats a disease, disorder or symptom. In certain embodiments, the cell is within a subject. In certain embodiments, the subject is a mammal. In certain embodiments, the subject is a human. In certain embodiments, the cell is selected from the group consisting of: central nervous system cells, frontal cortex cells, glial cells, microglial cells, and striatum cells. In certain embodiments, modulating expression of GRN treats a disease or disorder. In certain embodiments, the disorder is a central nervous system disorder. In certain embodiments, the disorder is Frontotemporal degeneration (FTD), Parkinson's disease, Alzheimer's disease, or Atherosclerosis. In certain embodiments, a symptom of the central nervous system disorder is a presence of Lewy bodies, haploinsufficiency of progranulin (GRN), social deficit, lysosomal abnormality, memory loss, loss of motor coordination, or muscular tremors. In certain embodiments, treating the central nervous system disorder comprises reducing the frequency of muscular tremors and/or reducing the severity of muscular tremors.

In another aspect, the application provides an expression cassette encoding a non-naturally occurring DNA binding protein comprising a DNA binding domain comprising three or more DNA binding domains, wherein the DNA binding protein increases or represses expression of an endogenous gene by a factor of at least 5-fold, and wherein the DNA binding protein has 90% or greater sequence identity to its closest human counterpart. In exemplary embodiments, the DNA binding domain comprises three or more zinc finger domains.

In certain embodiments, the DNA binding protein having 90% or greater sequence identity to its closest human counterpart binds to a target site in the human genome that the human counterpart protein does not naturally bind. In certain embodiments, the human counterpart is EGR1. In certain embodiments, the human counterpart is EGR3. In certain embodiments, the DNA binding protein having 90% or greater sequence identity to its closest human counterpart comprises at least 6 zinc finger domains. In certain embodiments, the DNA binding protein binding protein having 90% or greater sequence identity to its closest human counterpart comprises 9 zinc finger domains. In certain embodiments, the DNA binding domain having 90% or greater sequence identity to its closest human counterpart comprises at least one amino acid substitution at position −1, 2, 3 or 6 of recognition helices of one or more zinc finger domains. In certain embodiments, the DNA binding protein having 90% or greater sequence identity to its closest human counterpart comprises one or more zinc finger domains derived from EGR1 or EGR3.

In certain embodiments, the DNA binding protein having 90% or greater sequence identity to its closest human counterpart further comprises a transcription effector domain. In certain embodiments, the transcription effector domain is derived from CITED2 or CITED4. In certain embodiments, the transcription effector domain is positioned at C-terminus of the DNA binding domain in the DNA binding protein. In certain embodiments, the effector domain is positioned at N-terminus of the DNA binding domain in the DNA binding protein. In certain embodiments, the DNA binding protein having 90% or greater sequence identity to its closest human counterpart comprises an effector domain positioned at N-terminus of the DNA binding domain in the DNA binding protein and an effector domain positioned at C-terminus of the DNA binding domain in the DNA binding protein.

In certain embodiments, the DNA binding protein having 90% or greater sequence identity to its closest human counterpart recognizes a target binding site of 18 bp or longer. In certain embodiments, the DNA binding protein having 90% or greater sequence identity to its closest human counterpart recognizes a target binding site of 27 bp.

In certain embodiments, the expression cassette encoding the DNA binding protein having 90% or greater sequence identity to its closest human counterpart further comprises a cell type selective regulatory element. In certain embodiments, the expression cassette encoding the DNA binding protein having 90% or greater sequence identity to its closest human counterpart further comprises a regulatory element that drives expression of the DNA binding protein at a higher level in PV neurons than in other cell types. In certain embodiments, the regulatory element comprises a sequence having any one of SEQ ID NOs: 183, 184, 185, or 417. In certain embodiments, the regulatory element comprises a sequence having SEQ ID NO: 183 or 185.

In certain embodiments, the expression cassette encoding a DNA binding protein having 90% or greater sequence identity to its closest human counterpart is in a viral vector. In certain embodiments, the viral vector is AAV. In certain embodiments, the AAV is AAV9 or scAAV9.

In another aspect, the application provides a method of treating a disease or condition, the method comprising administering a gene therapy comprising any expression cassette provided herein encoding a DNA binding protein having 90% or greater sequence identity to its closest human counterpart. In certain embodiments, the DNA binding protein having 90% or greater sequence identity to its closest human counterpart elicits reduced or minimal immune response when expressed in a cell or in vivo. In certain embodiments, the cell is within a subject. In certain embodiments, the subject is a mammal. In certain embodiments, the subject is a human. In certain embodiments, the DNA binding protein having 90% or greater sequence identity to its closest human counterpart increases expression of endogenous SCN1A. In certain embodiments, the cell is a PV neuron. In certain embodiments, increasing expression of SCN1A treats a disease, disorder or symptom. In certain embodiments, the disorder is a central nervous system disorder. In certain embodiments, the disorder is Dravet Syndrome. In certain embodiments, the central nervous system disorder is neuronal hyperactivity. In certain embodiments, treating the central nervous system disorder comprises reducing neuronal hyperactivity. In certain embodiments, a symptom of the central nervous system disorder is seizures. In certain embodiments, treating the central nervous system disorder comprises reducing the frequency of seizures. In certain embodiments, treating the central nervous system disorder comprises reducing the severity of seizures. In certain embodiments, treating the central nervous system disorder comprises reducing the severity and frequency of seizures. In certain embodiments, the DNA binding protein having 90% or greater sequence identity to its closest human counterpart increases expression of endogenous GRN. In certain embodiments, the cell is selected from the group consisting of: central nervous system cells, frontal cortex cells, glial cells, microglial cells, and striatum cells. In certain embodiments, modulating expression of GRN treats a disease or disorder. In certain embodiments, the disorder is a central nervous system disorder. In certain embodiments, the disorder is Frontotemporal degeneration (FTD), Parkinson's disease, Alzheimer's disease, or Atherosclerosis. In certain embodiments, a symptom of the central nervous system disorder is a presence of Lewy bodies, haploinsufficiency of progranulin (GRN), social deficit, lysosomal abnormality, memory loss, loss of motor coordination, or muscular tremors. In certain embodiments, treating the central nervous system disorder comprises reducing the frequency of muscular tremors and/or reducing the severity of muscular tremors.

INCORPORATION BY REFERENCE

All publications, patents, and patent applications mentioned in this specification are herein incorporated by reference to the same extent as if each individual publication, patent, or patent application was specifically and individually indicated to be incorporated by reference.

BRIEF DESCRIPTION OF THE DRAWINGS

The novel features of the invention are set forth with particularity in the appended claims. A better understanding of the features and advantages of the present invention will be obtained by reference to the following detailed description that sets forth illustrative cases, in which the principles of the invention are utilized, and the accompanying drawings of which:

FIG. 18A illustrates the relative expression of SCN1A gene in mice with injected with either the control eGFP expression cassette or expression cassette A comprising a transcriptional activator that binds to target site that results in upregulation of expression from the endogenous SCN1A gene. FIG. 18B illustrates the change in SCN1A expression in terms of percentage mean eGFP. These experiments indicated transcriptional activator of expression cassette A resulted in about 20-30% upregulation of SCN1A expression.

FIG. 19A: Expression Cassette A; FIG. 19B: Expression Cassette B; and FIG. 19C: SEQ ID NOs: 365 or 366. The SCN1A transcription factors were compared to a control vector (EGFP-KASH) and CBA-EGFP-KASH. Data are presented as fold change with respect to the EGFP-KASH condition.

FIG. 21A illustrates the comparison between wild-type and Scn1a +/− mice in a survival assay. P1 Scn1a +/− (N=53) and Scn1a +/+ (N=54) mice were infused with PBS. Mice were observed in their home cage daily and in the case of any mortality, the date was recorded. There was a significant difference in survival between Scn1a +/− and Scn1a +/+ animals (P<0.0001). FIGS. 21B-E illustrate the effect on survival in a mouse model of Dravet syndrome for mice treated with various SCN1A specific transcription factors as compared to a control. P1 Scn1a +/− mice were infused with either PBS or an AAV9 vector expressing an SCN1A specific transcription factor (SEQ ID NO: 305-307, or 309). Mice were observed in their home cage daily and in the case of any mortality, the date was recorded.

FIG. 24A illustrates the relative expression of progranulin presented as fold change relative to the control. FIG. 24B illustrates the ELISA experiments with various transcriptional activators of progranulin, expressed in terms of hPGRN in supernatant (ng/mL).

DETAILED DESCRIPTION OF THE DISCLOSURE

Figure 1:
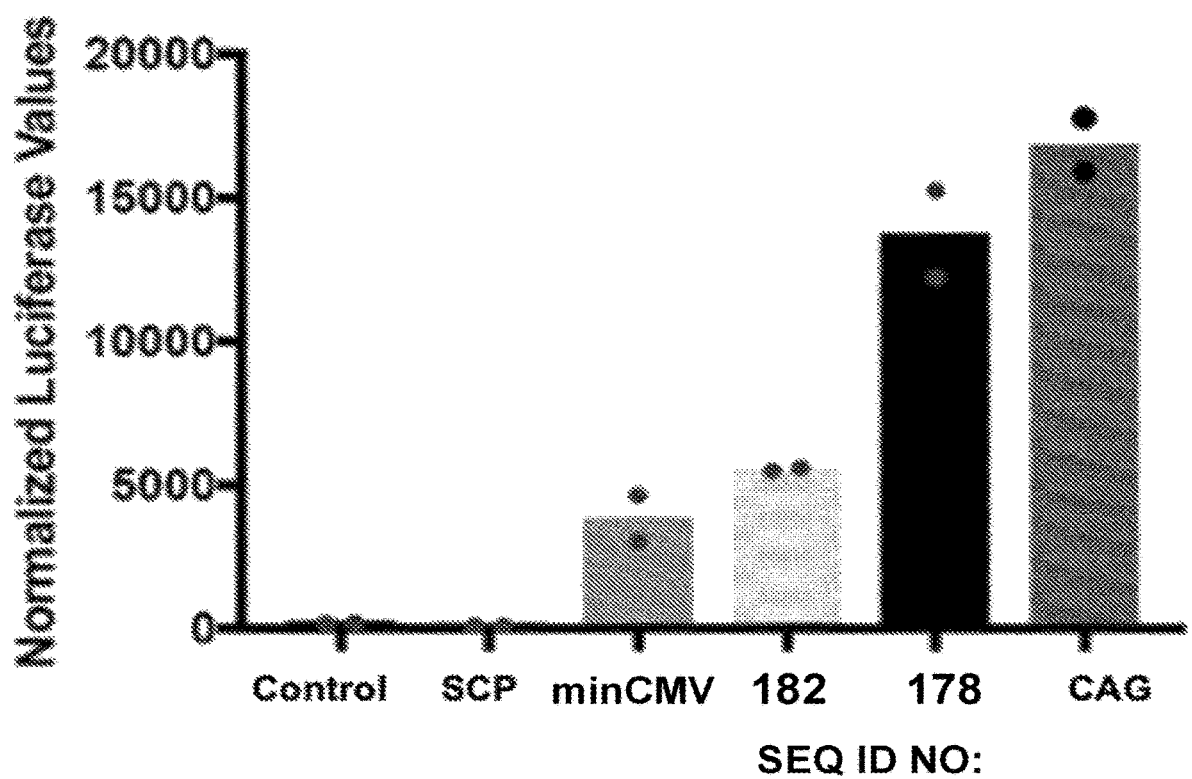
FIG. 1 illustrates the effect of different regulatory elements on expression of luciferase in 293T cells, measured in terms of normalized luciferase activity. For example, combined with a minimal CMV (minCMV) promoter drove expression of luciferase at a level about 1.4 fold higher than the expression driven by the minCMV promoter alone, and about 60 fold higher than the expression driven by a SCP promoter. In the same experiment, SEQ ID NO: 178 linked to a minCMV promoter drove expression of luciferase at a level about 3.5 fold higher than the minCMV promoter alone and about 140 fold higher than a SCP promoter.

Provided herein are engineered transcription factors, or eTFs, that are non-naturally occurring and have been designed to bind to a genomic target site and modulate expression of an endogenous gene of interest. Such eTFs may be designed to either upregulate or downregulate expression (RNA and/or protein expression) of a gene of interest.

In one aspect, the application provides eTFs that are capable of upregulating expression of the sodium voltage gated channel alpha subunit 1 (SCN1A) gene and increasing expression of its corresponding protein product Nav1.1 and methods of use thereof for treating diseases or disorders associated with a deficiency in Nav1.1, such as, for example, Dravet syndrome.

In another aspect, the application provides eTFs that are capable of upregulating expression of the progranulin (GRN) gene and increasing expression of the GRN protein and methods of use thereof for treating diseases or disorders associated with a deficiency in GRN, such as, for example, frontotemporal dementia (FTD).

In another aspect, the application provides eTFs having a high percent sequence identity to human proteins that can be designed to bind to a genomic target site and modulate expression (upregulation or downregulation) of any gene of interest, including, for example, SCN1A or GRN. Such eTFs have little to no immunogenicity when administered to a subject or have reduced immunogenicity as compared to eTFs having lower percent identity to human protein sequences.

Definitions

As used herein, the singular forms "a", "an" and "the" are intended to include the plural forms as well, unless the context clearly indicates otherwise. Furthermore, to the extent that the terms "including", "includes", "having", "has", "with", or variants thereof are used in either the detailed description and/or the claims, such terms are intended to be inclusive in a manner similar to the term "comprising".

The term "about" or "approximately" means within an acceptable error range for the particular value as determined by one of ordinary skill in the art, which will depend in part on how the value is measured or determined, i.e., the limitations of the measurement system. For example, "about" can mean within one or more than one standard deviation, per the practice in the art. Alternatively, "about" can mean a range of up to 20%, up to 15%, up to 10%, up to 5%, or up to 1% of a given value.

The terms "determining", "measuring", "evaluating", "assessing", "assaying", "analyzing", and their grammatical equivalents can be used interchangeably herein to refer to any form of measurement, and include determining if an element is present or not (for example, detection). These terms can include both quantitative and/or qualitative determinations. Assessing may be relative or absolute.

The term "expression" refers to the process by which a nucleic acid sequence or a polynucleotide is transcribed from a DNA template (such as into mRNA or other RNA transcript) and/or the process by which a transcribed mRNA is subsequently translated into peptides, polypeptides, or proteins. Transcripts and encoded polypeptides may be collectively referred to as "gene product." If the polynucleotide is derived from genomic DNA, expression may include splicing of the mRNA in a eukaryotic cell.

As used herein, "operably linked", "operable linkage", "operatively linked", or grammatical equivalents thereof refer to juxtaposition of genetic elements, e.g., a promoter, an enhancer, a polyadenylation sequence, etc., wherein the elements are in a relationship permitting them to operate in the expected manner. For instance, a regulatory element, which can comprise promoter and/or enhancer sequences, is operatively linked to a coding region if the regulatory element helps initiate transcription of the coding sequence. There may be intervening residues between the regulatory element and coding region so long as this functional relationship is maintained.

A "vector" as used herein refers to a macromolecule or association of macromolecules that comprises or associates with a polynucleotide and which can be used to mediate delivery of the polynucleotide to a cell. Examples of vectors include plasmids, viral vectors, liposomes, and other gene delivery vehicles. The vector generally comprises genetic elements, e.g., regulatory elements, operatively linked to a gene to facilitate expression of the gene in a target.

As used herein, "an expression cassette" and "a nucleic acid cassette" are used interchangeably to refer to a combination of nucleic acid sequences or elements that are expressed together or are operably linked for expression. In some cases, an expression cassette refers to the combination of regulatory elements and a gene or genes to which they are operably linked for expression.

The term "AAV" is an abbreviation for adeno-associated virus, and may be used to refer to the virus itself or a derivative thereof. The term covers all serotypes, subtypes, and both naturally occurring and recombinant forms, except where required otherwise. The abbreviation "rAAV" refers to recombinant adeno-associated virus, also referred to as a recombinant AAV vector (or "rAAV vector"). The term "AAV" includes AAV1, AAV2, AAV3, AAV4, AAV5, AAV6, AAV7, AAV8, AAV9, AAV10, AAV11, AAV12, rh10, and hybrids thereof, avian AAV, bovine AAV, canine AAV, equine AAV, primate AAV, non-primate AAV, and ovine AAV. The genomic sequences of various serotypes of AAV, as well as the sequences of the native terminal repeats (TRs), Rep proteins, and capsid subunits are known in the art. Such sequences may be found in the literature or in public databases such as GenBank. An "rAAV vector" as used herein refers to an AAV vector comprising a polynucleotide sequence not of AAV origin (i.e., a polynucleotide heterologous to AAV), typically a sequence of interest for the genetic transformation of a cell. In general, the heterologous polynucleotide is flanked by at least one, and generally by two, AAV inverted terminal repeat sequences (ITRs). An rAAV vector may either be single-stranded (ssAAV) or self-complementary (scAAV). An "AAV virus" or "AAV viral particle" refers to a viral particle composed of at least one AAV capsid protein and an encapsidated polynucleotide rAAV vector. If the particle comprises a heterologous polynucleotide (i.e., a polynucleotide other than a wild-type AAV genome such as a transgene to be delivered to a mammalian cell), it is typically referred to as an "rAAV vector particle" or simply an "rAAV particle". Thus, production of rAAV particle necessarily includes production of rAAV vector, as such a vector is contained within an rAAV particle.

As used herein, the terms "treat", "treatment", "therapy" and the like refer to alleviating, delaying or slowing the progression, prophylaxis, attenuation, reducing the effects or symptoms, preventing onset, inhibiting, or ameliorating the onset of the diseases or disorders. The methods of the present disclosure may be used with any mammal. Exemplary mammals include, but are not limited to rats, cats, dogs, horses, cows, sheep, pigs, and more preferably humans. A therapeutic benefit includes eradication or amelioration of the underlying disorder being treated. Also, a therapeutic benefit is achieved with the eradication or amelioration of one or more of the physiological symptoms associated with the underlying disorder such that an improvement is observed in the subject, notwithstanding that the subject may still be afflicted with the underlying disorder. In some cases, for prophylactic benefit, a therapeutic may be administered to a subject at risk of developing a particular disease, or to a subject reporting one or more of the physiological symptoms of a disease, even though a diagnosis of this disease may not have been made. The methods of the present disclosure may be used with any mammal. In some cases, the treatment can result in a decrease or cessation of symptoms (e.g., a reduction in the frequency, duration and/or severity of seizures). A prophylactic effect includes delaying or eliminating the appearance of a disease or condition, delaying or eliminating the onset of symptoms of a disease or condition, slowing, halting, or reversing the progression of a disease or condition, or any combination thereof.

The term "effective amount" or "therapeutically effective amount" refers to that amount of a composition described herein that is sufficient to affect the intended application, including but not limited to disease treatment, as defined below. The therapeutically effective amount may vary depending upon the intended treatment application (in vivo), or the subject and disease condition being treated, e.g., the weight and age of the subject, the severity of the disease condition, the manner of administration and the like, which can readily be determined by one of ordinary skill in the art. The term also applies to a dose that will induce a particular response in a target cell. The specific dose will vary depending on the particular composition chosen, the dosing regimen to be followed, whether it is administered in combination with other compounds, timing of administration, the tissue to which it is administered, and the physical delivery system in which it is carried.

A "fragment" of a nucleotide or peptide sequence refers to a sequence that is shorter than a reference or "full-length" sequence.

A "variant" of a molecule refers to allelic variations of such sequences, that is, a sequence substantially similar in structure and biological activity to either the entire molecule, or to a fragment thereof.

A "functional fragment" of a DNA or protein sequence refers to a fragment that retains a biological activity (either functional or structural) that is substantially similar to a biological activity of the full-length DNA or protein sequence. A biological activity of a DNA sequence can be its ability to influence expression in a manner known to be attributed to the full-length sequence.

The terms "subject" and "individual" are used interchangeably herein to refer to a vertebrate, preferably a mammal, more preferably a human. The methods described herein can be useful in human therapeutics, veterinary applications, and/or preclinical studies in animal models of a disease or condition.

The term "in vivo" refers to an event that takes place in a subject's body.

The term "in vitro" refers to an event that takes places outside of a subject's body. For example, an in vitro assay encompasses any assay run outside of a subject. In vitro assays encompass cell-based assays in which cells alive or dead are employed. In vitro assays also encompass a cell-free assay in which no intact cells are employed.

In general, "sequence identity" or "sequence homology", which can be used interchangeably, refer to an exact nucleotide-to-nucleotide or amino acid-to-amino acid correspondence of two polynucleotides or polypeptide sequences, respectively. Typically, techniques for determining sequence identity include comparing two nucleotide or amino acid sequences and the determining their percent identity. Sequence comparisons, such as for the purpose of assessing identities, may be performed by any suitable alignment algorithm, including but not limited to the Needleman-Wunsch algorithm (see, e.g., the EMBOSS Needle aligner available at www.ebi.ac.uk/Tools/psa/emboss_needle/, optionally with default settings), the BLAST algorithm (see, e.g., the BLAST alignment tool available at blast.ncbi.nlm.nih.gov/Blast.cgi, optionally with default settings), and the Smith-Waterman algorithm (see, e.g., the EMBOSS Water aligner available at www.ebi.ac.uk/Tools/psa/emboss water/, optionally with default settings). Optimal alignment may be assessed using any suitable parameters of a chosen algorithm, including default parameters. The "percent identity", also referred to as "percent homology", between two sequences may be calculated as the number of exact matches between two optimally aligned sequences divided by the length of the reference sequence and multiplied by 100. Percent identity may also be determined, for example, by comparing sequence information using the advanced BLAST computer program, including version 2.2.9, available from the National Institutes of Health. The BLAST program is based on the alignment method of Karlin and Altschul, Proc. Natl. Acad. Sci. USA 87:2264-2268 (1990) and as discussed in Altschul, et al., J. Mol. Biol. 215:403-410 (1990); Karlin and Altschul, Proc. Natl. Acad. Sci. USA 90:5873-5877 (1993); and Altschul et al., Nucleic Acids Res. 25:3389-3402 (1997). Briefly, the BLAST program defines identity as the number of identical aligned symbols (i.e., nucleotides or amino acids), divided by the total number of symbols in the shorter of the two sequences. The program may be used to determine percent identity over the entire length of the sequences being compared. Default parameters are provided to optimize searches with short query sequences, for example, with the blastp program. The program also allows use of an SEG filter to mask-off segments of the query sequences as determined by the SEG program of Wootton and Federhen, Computers and Chemistry 17: 149-163 (1993). High sequence identity generally includes ranges of sequence identity of approximately 80% to 100% and integer values there between.

As used herein, "engineered" with reference to a protein refers to a non-naturally occurring protein, including, but not limited to, a protein that is derived from a naturally occurring protein, or where a naturally occurring protein has been modified or reprogrammed to have a certain property.

As used herein, "synthetic" and "artificial" are used interchangeably to refer to a protein or a domain thereof that has low sequence identity (e.g., less than 50% sequence identity) to a naturally occurring human protein. For example, VPR and VP64 domains are synthetic transactivation domains.

As used herein, an "engineered transcription factor" or "eTF" refers to as a non-naturally occurring DNA binding protein or a non-naturally occurring transcription modulator that has been modified or reprogrammed to bind to a specific target binding site and/or to include a modified or replaced transcription effector domain.

As used herein, a "DNA binding domain" can be used to refer to one or more DNA binding motifs, such as a zinc finger or a basic helix-loop-helix (bHLH) motif, individually or collectively as part of a DNA binding protein.

The terms "transcription activation domain", "transcriptional activation domain", "transactivation domain", "transactivating domain" and "TAD" are used interchangeably herein and refer to a domain of a protein which in conjunction with a DNA binding domain can activate transcription from a promoter by contacting transcriptional machinery (e.g., general transcription factors and/or RNA polymerase) either directly or through other proteins known as co-activators.

The terms "transcriptional repressor domain", "transcription repressor domain" and "TRD" are used interchangeably herein and refer to a domain of a protein which in conjunction with a DNA binding domain can repress transcription from a promoter by contacting transcriptional machinery (e.g., general transcription factors and/or RNA polymerase) either directly or through other proteins known as co-repressors.

The term "GRCh38.p12" refers to Genome Reference Consortium Human Build 38 patch release 12 (GRCh38.p12) having GenBank Assembly Accession No. GCA_000001405.27 and dated 2017 Dec. 21.

Unless otherwise indicated, all terms used herein have the same meaning as they would to one skilled in the art and the practice of the present invention will employ, conventional techniques of molecular biology, microbiology, and recombinant DNA technology, which are within the knowledge of those of skill of the art.

Engineered Transcription Factors (eTFs)

Transcription factors (TFs) are proteins that bind specific sequences in the genome and control the expression of genes. The engineered transcription factors or eTFs provided herein are non-naturally occurring proteins that comprise a DNA binding domain (DBD) and at least one domain that is a transcriptional modulator, e.g., either a transcriptional activation domain (TAD) or a transcriptional repressor domain (TRD). In one embodiment, an eTF may comprise a DBD and a TAD (e.g., TAD-DBD or DBD-TAD), wherein the DBD and TAD may be derived from the same protein or from different proteins. In another embodiment, an eTF may comprise a DBD and two TADs, wherein the DBD and TADs are derived from the same protein, the DBD is derived from a first protein and both TADs are derived from a second protein, the DBD and one TAD are derived from a first protein and the second TAD is derived from a second protein, or the DBD is derived from a first protein, one TAD is derived from a second protein, and the second TAD is derived from a third protein (e.g., TAD1-DBD-TAD1 or TAD1-DBD-TAD2). In one embodiment, an eTF may comprise a DBD and a TRD (e.g., TRD-DBD or DBD-TRD), wherein the DBD and TRD may be derived from the same protein or from different proteins. In another embodiment, an eTF may comprise a DBD and two TRDs, wherein the DBD and TRDs are derived from the same protein, the DBD is derived from a first protein and both TRDs are derived from a second protein, the DBD and one TRD are derived from a first protein and the second TRD is derived from a second protein, or the DBD is derived from a first protein, one TRD is derived from a second protein, and the second TRD is derived from a third protein (e.g., TRD1-DBD-TRD1 or TRD1-DBD-TRD2). In certain embodiments, the DBD may be a synthetic construct that contains domains from multiple proteins.

In certain embodiments, a DBD and a TAD may be directly conjugated, e.g. with no intervening amino acid sequence. In other embodiments, a DBD and a TAD may be conjugated using a peptide linker. In certain embodiments, a DBD is conjugated to a TAD via a linker having 1, 2, 3, 4, 5, 6, 7, 8, 9, 10, 11, 12, 13, 14, 15, 16, 17, 18, 19, 20, 25, 30, 35, 40, 50, 60, 70, 75, 80, 90, or 100 amino acids, or from 1-5, 1-10, 1-20, 1-30, 1-40, 1-50, 1-75, 1-100, 5-10, 5-20, 5-30, 5-40, 5-50, 5-75, 5-100, 10-20, 10-30, 10-40, 10-50, 10-75, 10-100, 20-30, 20-40, 20-50, 20-75, or 20-100 amino acids. In some cases, the DBD and the TAD are conjugated via naturally occurring intervening residues found in the naturally occurring proteins from which the domains are derived. In other embodiments, the DBD and TAD are conjugated via a synthetic or exogenous linker sequence. Suitable linkers can be flexible, cleavable, non-cleavable, hydrophilic and/or hydrophobic. In certain embodiments, a DBD and a TAD may be fused together via a linker comprising a plurality of glycine and/or serine residues. Examples of glycine/serine peptide linkers include [GS]n, [GGGS]n (SEQ ID NO: 436), [GGGGS]n (SEQ ID NO: 437), [GGSG]n (SEQ ID NO: 438), wherein n is an integer equal to or greater than 1. In certain embodiments, a linker useful for conjugating a DBD and a TAD is GGSGGGSG (SEQ ID NO: 410). In certain embodiments, when a DBD is conjugated to two TADs, the first and second TADs may be conjugated to the DBD with the same or different linkers, or one TAD may be conjugated to the DBD with a linker and the other TAD is directly conjugated to the DBD (e.g., without an intervening linker sequence), or both TADs may be directly conjugated to the DBD (e.g., without intervening linker sequences).

The eTFs provided herein have different properties than naturally occurring transcription factors. In certain embodiments, an eTF provided herein comprises a DBD derived from a naturally occurring protein that has been modified such that the DBD binds to a different target site as compared to the naturally occurring protein from which it was derived, the eTF comprising such modified DBD modulates expression from a different gene as compared to the naturally occurring protein from which the DBD was derived, and/or the eTF comprising such modified DBD differently modulates expression of a target gene (e.g., upregulates vs. downregulates) as compared to the naturally occurring protein from which the DBD was derived. In other embodiments, an eTF provided herein comprises a TAD derived from a naturally occurring protein that has been modified such that the eTF comprising such modified TAD modulates expression from a different gene as compared to the naturally occurring protein from which the TAD was derived, and/or the eTF comprising such modified TAD differently modulates expression of a target gene (e.g., upregulates vs. downregulates) as compared to the naturally occurring protein from which the TAD was derived. In certain embodiments, an eTF provided herein comprises a DBD derived from a naturally occurring protein and a TAD derived from a naturally occurring protein (either the same or different proteins), wherein both the DBD and TAD have been modified. In such embodiments, the DBD may bind to a different target site as compared to the naturally occurring protein from which it was derived, the eTF comprising such modified DBD and TAD modulates expression from a different gene as compared to the naturally occurring proteins from which the domains were derived, and/or the eTF comprising such modified DBD and TAD differently modulates expression of a target gene (e.g., upregulates vs. downregulates) as compared to the naturally occurring proteins from which the DBD and TAD domains were derived.

DNA Binding Domains (DBDs)

The eTFs provided herein may comprise any suitable DBD that binds to a target site of interest. In certain embodiments, the DBD may be a synthetically designed DBD. In other embodiments, the DBD may be derived from a naturally occurring protein. DBD families include basic helix-loop-helix (bHLH) (e.g., c-Myc), basic-leucine zipper (e.g., C/EBP), helix-turn-helix (e.g., Oct-1), and zinc fingers (e.g., EGR3). These families exhibit a wide range of DNA binding specificities and gene targets. As contemplated herein, any one of the known human transcription factor proteins can serve as a protein platform for engineering and/or reprogramming a DBD to recognize a specific target site resulting in modulation of expression of an endogenous gene of interest. In exemplary embodiments, a DBD provided herein comprises a zinc finger domain, a TALEN binding domain, or a gRNA/Cas complex.

The DBD provided herein may be designed to recognize any target site of interest. In exemplary embodiments, a DBD is engineered to recognize a target site that is capable of modulating (e.g., upregulating or downregulating) expression from a gene of interest when bound by an eTF. In exemplary embodiments, a DBD is designed to recognize a genomic location and modulate expression of an endogenous gene when bound by an eTF. Binding sites capable of modulating expression of an endogenous gene of interest when bound by an eTF may be located anywhere in the genome that results in modulating of gene expression of the target gene. In various embodiments, the binding site may be located on a different chromosome from the gene interest, on the same chromosome as the gene of interest, upstream of the transcriptional start site (TSS) of the gene of interest, downstream of the TSS of the gene of interest, proximal to the TSS of the gene of interest, distal to the gene of interest, within the coding region of the gene of interest, within an intron of the gene of interest, downstream of the polyA tail of a gene of interest, within a promoter sequence that regulates the gene of interest, within an enhancer sequence that regulates the gene of interest, or within a repressor sequence that regulates the gene of interest.

The DBD may be designed to bind to a target binding site of any length so long as it provides specific recognition of the target binding site sequence by the DBD, e.g., with minimal or no off target binding. In certain embodiments, the target binding site may modulate expression of the endogenous gene of interest when bound by an eTF at a level that is at least 2-fold, 5-fold, 10-fold, 20-fold, 50-fold, 75-fold, 100-fold, 150-fold, 200-fold, 250-fold, 500-fold, or greater as compared to all other genes. In certain embodiments, the target binding site may modulate expression of the endogenous gene of interest when bound by an eTF at a level that is at least 2-fold, 5-fold, 10-fold, 20-fold, 50-fold, 75-fold, 100-fold, 150-fold, 200-fold, 250-fold, 500-fold, or greater as compared to the 40 nearest neighbor genes (e.g., the 40 genes located closest on the chromosome, either upstream or downstream, of the coding sequence of the gene of interest). In certain embodiments, the target binding site may be at least 5 bp, 10 bp, 15 bp, 20 bp, 25 bp, 30 bp, 35 bp, 40 bp, 45 bp or 50 bp, or more. The specific length of the binding site will be informed by the type of DBD in the eTF. In general, the longer the length of the binding site, the greater the specificity for binding and modulation of gene expression (e.g., longer binding sites have fewer off target effects). In certain embodiments, an eTF having a DBD recognizing a longer target binding site has fewer off-target effects associated with non-specific binding (such as, for example, modulation of expression of an off-target gene or gene other than the gene of interest) relative to the off-target effects observed with an eTF having a DBD that binds to a shorter target site. In some cases, the reduction in off-target binding is at least 1.2, 1.3, 1.4, 1.5, 2, 3, 4, 5, 6, 7, 8, 9, or 10 fold lower as compared to a comparable eTF having a DBD that recognizes a shorter target binding site.

In certain embodiments, a DBD provided herein can be modified to have increased binding affinity such that it binds to a target binding site longer such that a TAD conjugated to the DBD is able to recruit more transcription factors and/or recruit such transcription factor for a longer period of time to exert a greater effect on the expression level of the endogenous gene of interest. In certain embodiments, an eTF can be engineered so that the DBD binds stably to a target binding site and blocks transcription or the transcription machinery needed to express an endogenous gene. In certain embodiments, a DBD may be modified to increase its specific binding (or on-target binding) to a desired target site and/or modified to decrease its non-specific or off-target binding.

In various embodiments, binding between a DBD or eTF and a target binding site may be determined using various methods. In certain embodiments, specific binding between a DBD or eTF and a target binding site may be determined using a mobility shift assay, DNase protection assay, or any other in vitro method known in the art for assaying protein-DNA binding. In other embodiments, specific binding between an eTF and a target binding site may be determined using a functional assay, e.g., by measuring expression (RNA or protein) of a gene when the target binding site is bound by the eTF. For example, a target binding site may be positioned upstream of a reporter gene (such as, for example, eGFP) or the target gene of interest on a vector contained in a cell or integrated into the genome of the cell, wherein the cell expresses the eTF. Greater levels of expression of the reporter gene (or target gene of interest) in the presence of the eTF as compared to a control (e.g., no eTF or an eTF that recognizes a different target site) indicate that the DBD of the eTF binds to the target site. Suitable in vitro (e.g., non cell based) transcriptional and translational systems may also be used in a similar manner. In certain embodiments, an eTF that binds to a target site may have at least 2-fold, 3-fold, 5-fold, 10-fold, 15-fold, 20-fold, 30-fold, 50-fold, 75-fold, 100-fold, 150-fold, or greater expression of the reporter gene or target gene of interest as compared to a control (e.g., no eTF or an eTF that recognizes a different target site).

In other embodiments, an eTF provided herein may comprise a DBD from a zinc finger protein, derived from a zinc finger protein, or that is a nuclease is inactivated zinc finger protein. A zinc finger is a small protein structural motif that is characterized by the coordination of one or more zinc ions ($Zn'$) in order to stabilize the fold. Zinc finger (Znf) domains are relatively small protein motifs that contain multiple finger-like protrusions that make tandem contacts with a DNA target site. The modular nature of the zinc finger motif allows for a large number of combinations of DNA sequences to be bound with high degree of affinity and specificity, and is therefore ideally suited for engineering protein that can be targeted to and bind specific DNA sequences. Many engineered zinc finger arrays are based on the zinc finger domain of the murine transcription factor Zif268. Zif268 has three individual zinc finger motifs that collectively bind a 9 bp sequence with high affinity. A wide variety of zinc fingers proteins have been identified and are characterized into different types based on structure as further described herein. Any such zinc finger protein is useful in connection with the DBDs described herein.

Various methods for designing zinc finger proteins are available. For example, methods for designing zinc finger proteins to bind to a target DNA sequence of interest are described, see e.g., Liu Q, et al., Design of polydactyl zinc-finger proteins for unique addressing within complex genomes, Proc Natl Acad Sci USA. 94 (11): 5525-30 (1997); Wright D A et al., Standardized reagents and protocols for engineering zinc finger nucleases by modular assembly, Nat Protoc. Nat Protoc. 2006; 1(3):1637-52; and CA Gersbach and T Gaj, Synthetic Zinc Finger Proteins: The Advent of Targeted Gene Regulation and Genome Modification Technologies, Am Chem Soc 47: 2309-2318 (2014). In addition, various web based tools for designing zinc finger proteins to bind to a DNA target sequence of interest are publicly available, see e.g., the Zinc Finger Nuclease Design Software Tools and Genome Engineering Data Analysis website from OmicX, available on the world wide web at omictools.com/zfns-category; and the Zinc Finger Tools design website from Scripps available on the world wide web at scripps.edu/barbas/zfdesign/zfdesignhome.php. In addition, various commercially available services for designing zinc finger proteins to bind to a DNA target sequence of interest are available, see e.g., the commercially available services or kits offered by. Creative Biolabs (world wide web at creative-biolabs.com/Design-and-Synthesis-of-Artificial-Zinc-Finger-Proteins.html), the Zinc Finger Consortium Modular Assembly Kit available from Addgene (world wide web at addgene.org/kits/zfc-modular-assembly/), or the CompoZr Custom ZFN Service from Sigma Aldrich (world wide web at sigmaaldrich.com/life-science/zinc-finger-nuclease-technology/custom-zfn.html).

In certain embodiments, the eTFs provided herein comprise a DBD comprising one or more zinc fingers or is derived from a DBD of a zinc finger protein. In some cases, the DBD comprises multiple zinc fingers, wherein each zinc finger is linked to another zinc finger or another domain either at its N-terminus or C-terminus, or both via an amino acid linker. In some cases, a DBD provided herein comprises one or more zinc fingers from one or more of the zinc finger types described in TABLE 5. In some cases, a DBD provided herein comprises a plurality of zinc finger structures or motifs, or a plurality of zinc fingers having one or more of SEQ ID NOs: 115-130 or 141-164, or any combination thereof. In certain embodiments, a DBD comprises X-[ZF-X]n and/or [X-ZF]n-X, wherein ZF is a zinc finger domain having any one of the motifs listed in TABLE 5 (e.g., any one of SEQ ID NOs: 39-49), X is an amino acid linker comprising 1-50 amino acids, and n is an integer from 1-15, e.g., 1, 2, 3, 4, 5, 6, 7, 8, 9, 10, 11, 12, 13, 14, or 15, wherein each ZF can independently have the same sequence or a different sequence from the other ZF sequences in the DBD, and wherein each linker X can independently have the same sequence or a different sequence from the other X sequences in the DBD. Each zinc finger can be linked to another sequence, zinc finger, or domain at its C-terminus, N-terminus, or both. In a DBD, each linker X can be identical in sequence, length, and/or property (e.g., flexibility or charge), or be different in sequence, length, and/or property. In some cases, two or more linkers may be identical, while other linkers are different. In exemplary embodiments, the linker may be obtained or derived from the sequences connecting the zinc fingers found in one or more naturally occurring zinc finger proteins provided in TABLE 5. In other embodiments, suitable linker sequences, include, for example, linkers of 5 or more amino acids in length. See, also, U.S. Pat. Nos. 6,479,626; 6,903,185; and 7,153,949 for exemplary linker sequences of 6 or more amino acids in length, each of which is incorporated herein in their entireties. The DBD proteins provided herein may include any combination of suitable linkers between the individual zinc fingers of the protein. The DBD proteins described herein may include any combination of suitable linkers between the individual zinc fingers of the protein.

In certain embodiments, a DBD provided herein comprises one or more classic zinc fingers. A classical C2H2 zinc-finger has two cysteines in one chain and two histidine residues in another chain, coordinated by a zinc ion. A classical zinc-finger domain has two β-sheets and one α-helix, wherein the α-helix interacts with a DNA molecule and forms the basis of the DBD binding to a target site and may be referred to as the "recognition helix". In exemplary embodiments, the recognition helix of a zinc fingers comprises at least one amino acid substitution at position −1, 2, 3 or 6 thereby changing the binding specificity of the zinc finger domain. In other embodiments, an DBD provided herein comprises one or more non-classical zinc-fingers, e.g., C2-H2, C2-CH, and C2-C2.

In another embodiment, a DBD domain provided herein comprises a zinc finger motif having the following structure: LEPGEKP-[YKCPECGKSFS X HQRTH TGEKP]n-YKCPECGKSFS X HQRTH-TGKKTS (SEQ ID NO: 421), wherein n is an integer from 1-15, e.g., 1, 2, 3, 4, 5, 6, 7, 8, 9, 10, 11, 12, 13, 14, or 15, and each X independently is a recognition sequence (e.g., a recognition helix) capable of binding to 3 bp of the target sequence. In exemplary embodiments, n is 3, 6 or 9. In a particularly preferred embodiment, n is 6. In various embodiments, each X may independently have the same amino acid sequence or a different amino acid sequence as compared to other X sequences in the DBD. In an exemplary embodiment, each X is sequence comprising 7 amino acids that has been designed to interact with 3 bp of the target binding site of interest using the Zinger Finger Design Tool from Scripps located on world wide web at scripps.edu/barbas/zfdesign/zfdesignhome.php.

Since each zinc finger within a DBD recognizes 3 bp, the number of zinc fingers included in the DBD informs the length of the binding site recognized by the DBD, e.g., a DBD with 1 zinc finger will recognize a target binding site having 3 bp, a DBD with 2 zinc fingers will recognize a target binding site having 6 bp, a DBD with 3 zinc fingers will recognize a target binding site having 9 bp, a DBD with 4 zinc fingers will recognize a target binding site having 12 bp, a DBD with 5 zinc fingers will recognize a target binding site having 15 bp, a DBD with 6 zinc fingers will recognize a target binding site having 18 bp, a DBD with 9 zinc fingers will recognize a target binding site having 27 bp, etc. In general, DBD that recognize longer target binding sites will exhibit greater binding specificity (e.g., less off target or non-specific binding).

In other embodiments, a DBD provided herein is derived from a naturally occurring zinc finger protein by making one or more amino acid substitutions in one or more of the recognition helices of the zinc finger domains so as to change the binding specificity of the DBD (e.g., changing the target site recognized by the DBD). DBD provided herein may be derived from any naturally occurring zinc finger protein. In various embodiments, such DBD may be derived from a zinc finger protein of any species, e.g., a mouse, rat, human, etc. In an exemplary embodiment, a DBD provided herein is derived from a human zinc finger protein. In certain embodiments, a DBD provided herein is derived from a naturally occurring protein listed in TABLE 5. In an exemplary embodiment, a DBD protein provided herein is derived from a human EGR zinc finger protein, e.g., EGR1, EGR2, EGR3, or EGR4.

In certain embodiments, a DBD provided herein is derived from a naturally occurring protein by modifying the DBD to increase the number of zinc finger domains in the DBD protein by repeating one or more zinc fingers within the DBD of the naturally occurring protein. In certain embodiments, such modifications include duplication, triplication, quadruplication, or further multiplication of the zinc fingers within the DBD of the naturally occurring protein. In some cases, one zinc finger from a DBD of a human protein is multiplied, e.g., 2, 3, 4, 5, 6, 7, 8, 9, 10, 11, 12, or more copies of the same zinc finger motif is repeated in the DBD of the eTF. In some cases, a set of zinc fingers from a DBD of a naturally occurring protein is multiplied, e.g., a set of 3 zinc fingers from a DBD of a naturally occurring protein is duplicated to yield an eTF having a DBD with 6 zinc fingers, is triplicated to yield a DBD of an eTF with 9 zinc fingers, or is quadruplicated to yield a DBD of an eTF with 12 zinc fingers, etc. In some cases, a set of zinc fingers from a DBD of a naturally occurring protein is partially replicated to form a DBD of an eTF having a greater number of zinc fingers, e.g., a DBD of an eTF comprises four zinc fingers wherein the zinc fingers represent one copy of the first zinc finger, one copy of the second zinc finger, and two copies of a third zinc finger from a naturally occurring protein for a total of four zinc fingers in the DBD of the eTF. Such DBD are then further modified by making one or more amino acid substitutions in one or more of the recognition helices of the zinc finger domains so as to change the binding specificity of the DBD (e.g., changing the target site recognized by the DBD). In exemplary embodiments, the DBD is derived from a naturally occurring human protein, such as a human EGR zinc finger protein, e.g., EGR1, EGR2, EGR3, or EGR4.

Human EGR1 and EGR3 are characterized by a three-finger C2H2 zinc finger DBD. The generic binding rules for zinc fingers provide that all three fingers interact with its cognate DNA sequence with similar geometry, using the same amino acids in the alpha helix of each zinc finger to determine the specificity or recognition of the target binding site sequence. Such binding rules allow one to modify the DBD of EGR1 or EGR3 to engineer a DBD that recognizes a desired target binding site. In some cases, the 7-amino acid DNA recognition helix in a zinc finger motif of EGR1 or EGR3 is modified according to published zinc finger design rules. In certain embodiments, each zinc finger in the three-finger DBD of EGR1 or EGR3 is modified, e.g., by altering the sequence of one or more recognition helices and/or by increasing the number of zinc fingers in the DBD. In certain embodiments, EGR1 or EGR3 is reprogrammed to recognize a target binding site of at least 9, 12, 15, 18, 21, 24, 27, 30, 33, 36 or more base pairs at a desired target site. In certain embodiments, such DBD derived from ERG1 or EGR3 comprises at least 3, 4, 5, 6, 7, 8, 9, 10, 11, 12, or more zinc fingers. In exemplary embodiment, one or more of the zinc fingers in the DBD comprises at least one amino acid substitution at position −1, 2, 3 or 6 of the recognition helix.

In various embodiments, an eTF comprising a DBD derived from EGR1 or EGR3 has a DNA binding specificity that is different from the binding specificity of naturally occurring EGR1 or EGR3, e.g., the DBD recognizes a target binding site having a sequence different from the sequence of the binding site recognized by unmodified EGR1 or EGR3: (GCG(T/G)GGGCG) (SEQ ID NO: 373).

In other embodiments, an eTF provided herein comprises a DBD that is a gRNA/Cas complex. CRISPR (clustered regularly interspaced short palindromic repeats)/Cas9 is a genome editing tools that allows for site-specific genomic targeting. The type II CRISPR/Cas system is a prokaryotic adaptive immune response system that uses noncoding RNAs to guide the Cas9 nuclease to induce site-specific DNA cleavage. The CRISPR/Cas9 system has been harnessed to create a simple, RNA-programmable method to mediate genome editing in mammalian cells. A single guide RNA (sgRNA) may be generated to direct the Cas9 nuclease to a specific genomic location that is then bound by the gRNA/Cas9 complex. A gRNA may be designed to bind to a target site of interest using various methods and tools. For example, methods for designing gRNAs to bind to a target DNA sequence of interest are described in Aach, et al. Flexible algorithm for identifying specific Cas9 targets in genomes. BioRxiv, Cold Spring Harbor Labs. doi: http://dx.doi.org/10.1101/005074 (2014); Bae, et al. Cas-OFFinder: a fast and versatile algorithm that searches for potential off-target sites of Cas9 RNA-guided endonucleases. Bioinformatics. 30(10):1473-1475 (2014); Doench, J. G. et al. Optimized sgRNA design to maximize activity and minimize off-target effects of CRISPR-Cas9. Nat Biotech 34, 184-191 (2016); Gratz, et al. Highly specific and efficient CRISPR/Cas9-catalyzed homology-directed repair in Drosophila. Genetics. 196(4):961-971 (2014); Heigwer, et al. E-CRISP: fast CRISPR target site identification. Nat Methods. 11(2):122-123 (2014); Ma, et al. A guide RNA sequence design platform for the CRISPR/Cas9 system for model organism genomes. Biomed Res Int. doi:http://doi.org/10.1155/2013/270805 (2013); Montague, et al. CHOPCHOP: a CRISPR/Cas9 and TALEN web tool for genome editing. Nucleic Acids Res. 42 (W1):W401-W407 (2014); Liu, et al. CRISPR-ERA: a comprehensive design tool for CRISPR-mediated gene editing, repression and activation. Bioinformatics. 31(22):3676-3678 (2015); Ran, et al. In vivo genome editing using *Staphylococcus aureus* Cas9. Nature. 520(7546):186-191 (2015); Wu, et al. Target specificity of the CRISPR-Cas9 system. Quant Biol. 2(2): 59-70 (2015); Xiao, et al. CasOT: a genome-wide Cas9/gRNA off-target searching tool. Bioinformatics. 30(8):1180-1182 (2014); Zetsche, et al. Cpf1 is a single RNA-guided endonuclease of a Class 2 CRISPR-Cas System. Cell. 163 (3):759-771 (2015). In addition, various web based tools for designing gRNAs to bind to a DNA target sequence of interest are publicly available, see e.g., the CRISPR gRNA Design tool available from AUTM on world wide web at atum.bio/eCommerce/cas9/input?multipleContacts=false; the CRISPRa/i gRNA design tool available from the Broad Institute on the world wide web at portals.broadinstitute.org/gpp/public/analysis-tools/sgrna-design-crisprai; the E-CRISP design tool available from DKFZ German Cancer Research Center available on the world wide web at e-crisp.org/E-CRISP/; and the Knockout Guide Design tool available from Synthego on the world wide web at design.synthego.com/#/. In addition, various commercially available services for designing gRNAs to bind to a DNA target sequence of interest are available, see e.g., the commercially available services offered by IDT (world wide web at idtdna.com/site/order/designtool/index/CRISPR_SEQUENCE), ThermoFisher (world wide web at thermofisher.com/order/custom-oligo/crispr), and GenScript (world wide web at genscript.com/gRNA-design-tool.html).

In exemplary embodiments, a DBD that is a gRNA/Cas complex comprises a nuclease deactivated Cas protein or dCas, such as for example, a dCas9, such as nuclease deactivated *Staphylococcus aureus* (dSaCas9) or nuclease deactivated *Streptococcus pyogenes* Cas9 (dSpCas9). The gRNA is provided as a sequence comprising a targeting region, which targets the gRNA/Cas complex to a desired target site, and scaffold region, that facilitates the interaction with the Cas protein. Any suitable gRNA scaffold may be used in connection with the gRNAs provided herein. In an exemplary embodiment, the gRNA is a single gRNA or sgRNA and comprises the following scaffold sequence: 5'-GTTTTAGTACTCTGGAAACAGAATC-TACTAAAACAAGGCAAAATGCCGTGTTTATCTCG TCAACTTGTTGGCGAGA-3' (SEQ ID NO: 102). The targeting region of the guide RNA is attached to the 5' end of the scaffold sequence to form the complete sgRNA. In certain embodiments, a gRNA and dCas protein may be expressed from the same expression cassette. In certain embodiments, a U6 promoter is used to express the gRNA. In other embodiments, a gRNA may be expressed in a cell that has been engineered to stably express the dCas-TAD protein, e.g., either by stably integrating the dCas into the genome or on a plasmid that is stably maintained extrachromosomally.

In other embodiments, an eTF provided herein may comprise a DBD from a TALEN, derived from a TALEN, or that is a nuclease is inactivated TALEN. Transcription activator-like effector nucleases (TALEN) are restriction enzymes that contain a DBD and a nuclease domain that can be engineered to cut specific sequences of DNA. TALENs are created by conjugating a TAL effector DNA binding domain to a DNA cleavage domain (e.g., a nuclease). Transcription activator-like effectors (TALEs) can be engineered to bind to a desired target DNA sequence thereby directing the nuclease domain to a specific location.

TAL effectors are bacterial proteins from *Xanthomonas* bacteria. The DNA binding domain contains a repeated highly conserved 33-34 amino acid sequence with divergent 12th and 13th amino acids. These two positions, referred to as the Repeat Variable Diresidue (RVD), are highly variable and show a strong correlation with specific nucleotide recognition. This straightforward relationship between amino acid sequence and DNA recognition allows the engineering of DBDs that specifically target a desired sequence by selecting a combination of repeat segments containing the appropriate RVDs.

Various methods for designing TALEs are available. For example, methods for designing TALEs to bind to a target DNA sequence of interest are described in T. Cermak et al., *Nucleic Acids Research.* 39 (12): e82 (2011); F. Zhang F et al., *Nature Biotechnology.* 29 (2): 149-53 (2011); R. Morbitzer et al., *Nucleic Acids Research.* 39 (13): 5790-9 (2011); T. Li et al., *Nucleic Acids Research.* 39 (14): 6315-25 (2011); R. Geissler et al., *PLOS One.* 6(5): e19509 (2011); and E. Weber et al., *PLOS One.* 6 (5): e19722 (2011). In addition, various web based tools for designing TALEs to bind to a DNA target sequence of interest are publicly available, see e.g., the E-Talen available on the world wide web at e-talen.org/E-TALEN/TAL and the Effector Nucleotide Targeter 2.0 tool available on the world wide web at tale-nt.cac.cornell.edu/node/add/single-tale. In addition, various commercially available services for designing TALEs to bind to a DNA target sequence of interest are available, see e.g., the commercially available services offered by OmicX (world wide web at omictools.com/), Addgene (world wide web at addgene.org/talen/guide/), or ThermoFisher (world wide web at thermofisher.com/us/en/home/life-science/genome-editing/geneart-tals/tal-design-tool.html). In addition, the publicly available software program (DNAWorks) may be used to design oligonucleotides suitable for assembly of TALEs, see e.g., D. Hoover D *Methods in Molecular Biology.* 852: 215-23 (2012).

Transcriptional Modulation Domains

The eTFs provided herein may comprise any suitable domain that is capable of recruiting one or more protein factors that can modulate transcription (e.g., RNA polymerase II, CBP/p300, CREB or KRAB) or the level of gene expression from a gene of interest when the eTF is bound to a target site via the DBD (e.g., a zinc finger DBD, gRNA/Cas DBD, or TALE DBD). In certain embodiments, such a domain recruits protein factors that increase the level of transcription or gene expression of a gene of interest and is a transcriptional activation domain (TAD). In other embodiments, such a domain recruits protein factors that decrease the level of transcription or gene expression from a gene of interest and is a transcriptional repressor domain (TRD). In certain embodiments, the transcriptional modulation domain (TAD or TRD) may be a synthetically designed domain. In other embodiments, the transcriptional modulation domain (TAD or TRD) may be derived from a naturally occurring protein, e.g., a transcription factor, a transcriptional co-activator, a transcriptional co-repressor, or a silencer protein. In various embodiments, the transcriptional modulation domain (TAD or TRD) may be derived from a protein of any species, e.g., a mouse, rat, monkey, virus, or human.

In one exemplary embodiment, a TAD suitable for use in the eTFs provided herein is derived from a viral protein. Exemplary TADs derived from viral proteins include, for example, a TAD domain of VP64 (SEQ ID NO: 95), VPR (SEQ ID NO: 114), VP16, VP128, p65, p300, or any functional fragment or variant thereof, or a sequence having at least 80%, 85%, 90%, 91%, 92%, 93%, 94%, 95%, 96%, 97%, 98%, or 99% sequence identity thereto.

In another exemplary embodiment, a TAD suitable for use in the eTFs provided herein is derived from a human protein. Exemplary TADs derived from human proteins include, for example, a TAD domain of CBP/p300-interacting transactivator 2 (CITED2) (SEQ ID NO: 96 or 98), CBP/p300-interacting transactivator 4 (CITED4) (SEQ ID NO: 97 or 100), EGR1 (SEQ ID NO: 1), or EGR3 (SEQ ID NO: 422), or any functional fragment or variant thereof, or a sequence having at least 80%, 85%, 90%, 91%, 92%, 93%, 94%, 95%, 96%, 97%, 98%, or 99% sequence identity thereto.

In another exemplary embodiment, a TRD suitable for use in the eTFs provided herein comprises a KRAB domain that can recruit proteins that inhibit transcription, or any functional fragment or variant thereof, or a sequence having at least 80%, 85%, 90%, 91%, 92%, 93%, 94%, 95%, 96%, 97%, 98%, or 99% sequence identity thereto.

In certain embodiments, a zinc finger DBD is conjugated to a transcriptional modulation domain such as a TAD or TRD as further described below. In various embodiments, the zinc finger DBD may be conjugated to a TAD from a viral protein, such as VP64 or VPR, or a TAD from a human protein, such as CITED2 or CITED4. In certain embodiments, a zinc finger DBD derived from a human protein, e.g., EGR1 or EGR3, is conjugated to a TAD derived from a human protein, e.g., CITED2 or CITED4. In certain embodiments, a zinc finger DBD derived from a human protein, e.g., EGR1 or EGR3, is conjugated to a VP64 or VPR TAD. In certain embodiments, a synthetic zinc finger DBD or zinc finger DBD having less than 75% sequence identity to a human protein, e.g., EGR1 or EGR3, is conjugated to a TAD derived from a human protein, e.g., CITED2 or CITED4. In certain embodiments, a synthetic zinc finger DBD or zinc finger DBD having less than 75% sequence identity to a human protein, e.g., EGR1 or EGR3, is conjugated to a VP64 or VPR TAD.

In certain embodiments, a dCas protein is conjugated to a transcriptional modulation domain such as a TAD or TRD as further described below. In various embodiments, the dCas9 may be conjugated to a TAD from a viral protein, such as VP64 or VPR, or a TAD from a human protein, such as CITED2 or CITED4. In exemplary embodiments, a dCas9 is conjugated to a VP64 or VPR TAD.

In certain embodiments, a TALE protein is conjugated to a transcriptional modulation domain such as a TAD or TRD as further described below. In various embodiments, the TALE may be conjugated to a TAD from a viral protein, such as VP64 or VPR, or a TAD from a human protein, such as CITED2 or CITED4. In exemplary embodiments, a TALE is conjugated to a VP64 or VPR TAD.

eTFs that Upregulate SCN1A

In one aspect, the application provides eTFs that are capable of upregulating expression of the sodium voltage gated channel alpha subunit 1 (SCN1A) gene and increasing expression of its corresponding protein product Nav1.1. The SCN1A gene belongs to a family of genes that code for subunits used for assembling sodium channels. These channels, which transport positively charged sodium ions into cells, play a key role in a cell's ability to generate and transmit electrical signals. The SCN1A gene encodes one part (the alpha subunit) of a sodium channel called Nav1.1. These channels are primarily found in the brain, where they control the flow of sodium ions into cells. Nav1.1 channels are involved in transmitting signals from one nerve cell (or neuron) to another. Several mutations in the SCN1A gene have been found to cause genetic epilepsy with febrile seizures plus (GEFS+), which is a spectrum of seizure disorders of varying severity. These conditions include simple febrile (fever-associated) seizures, which start in infancy and usually stop by age 5, and febrile seizures plus (FS+). FS+ involves febrile and other types of seizures, including those not related to fevers (afebrile seizures), that continue beyond childhood. The GEFS+ spectrum also includes other conditions, such as Dravet syndrome (also known as severe myoclonic epilepsy of infancy or SMEI), that cause more serious seizures that last longer and may be difficult to control. These recurrent seizures (epilepsy) can worsen over time and are often accompanied by a decline in brain function. Many other mutations have been associated with familial hemiplegic migraine, a form of migraine headache that runs in families and at least one mutation has been associated with the effectiveness of certain anti-seizure medications. Thus, an eTF provided herein that increases expression of SCN1A can be used to treat a variety of disease or disorders associated with mutations in the Nav1.1 channel.

In certain embodiments, an eTF disclosed herein that upregulates SCN1A recognizes a target binding site that is at least 9 bp, 12 bp, 15 bp, 18 bp, 21 bp, 24 bp, 27 bp, 30 bp, 33 bp, or 36 bp in size; more than 9 bp, 12 bp, 15 bp, 18 bp, 21 bp, 24 bp, 27 bp, or 30 bp; or from 9-33 bp, 9-30 bp, 9-27 bp, 9-24 bp, 9-21 bp, 9-18 bp, 9-15 bp, 9-12 bp, 12-33 bp, 12-30 bp, 12-27 bp, 12-24 bp, 12-21 bp, 12-18 bp, 12-15 bp, 15-33 bp, 15-30 bp, 15-27 bp, 15-24 bp, 15-21 bp, 15-18 bp, 18-33 bp, 18-30 bp, 18-27 bp, 18-24 bp, 18-21 bp, 21-33 bp, 21-30 bp, 21-27 bp, 21-24 bp, 24-33 bp, 24-30 bp, 24-27 bp, 27-33 bp, 27-30 bp, or 30-33 bp. In exemplary embodiments, an eTF disclosed herein that upregulates SCN1A recognizes a target binding site that is 18-27 bp, 18 bp, or 27 bp.

In certain embodiments, an eTF disclosed herein that upregulates SCN1A recognizes a target binding site that is located on chromosome 2. In certain embodiments, an eTF disclosed herein that upregulates SCN1A recognizes a target binding site that is located on chromosome 2 within 110 kb, 100 kb, 90 kb, 80 kb, 70 kb, 60 kb, 50 kb, 40 kb, 30 kb, 20 kb, 10 kb, 5 kb, 4 kb, 3 kb, 2 kb, or 1 kb upstream or downstream of the TSS of SCN1A. In certain embodiments, an eTF disclosed herein that upregulates SCN1A recognizes a target binding site that is located on chromosome 2 within 110 kb upstream of the TSS of SCN1A. In certain embodiments, an eTF disclosed herein that upregulates SCN1A recognizes a target binding site that is located on chromosome 2 within 110 kb downstream of the TSS of SCN1A. In exemplary embodiments, such target binding sites are 18-27 bp, 18 bp, or 27 bp.

In certain embodiments, an eTF disclosed herein that upregulates SCN1A recognizes a target binding site that is located on chromosome 2 within positions 166179652-165989571, within positions 166128050-166127958, within positions 166155414-166140590, within positions 166179652-1661777272, or within positions 1659990246-165989592 (all with reference to GRCh38.p12). In exemplary embodiments, such target binding sites are 18-27 bp, 18 bp, or 27 bp.

In certain embodiments, an eTF disclosed herein that upregulates SCN1A recognizes a target binding site that is (i) 18-27 bp, 18 bp, or 27 bp, (ii) overlaps with a position on chromosome 2 selected from 166178880, 166178871, 166177369, 166177362, 166177299, 166177299, 166155393, 166155264, 166149373, 166149176, 166149165, 166149118, 166148953, 166148565, 166142396, 166142391, 166142344, 166142239, 166141162, 166140928, 166140590, 165990076, 165989684, 165989571, 166155255, 166155099, 166148843, 166148361, 166142219, 166141090, 165990246, 165990193, 166149168, 166127991, 166128002, 166128037, or 166128025 (all with reference to GRCh38.p12), and (iii) is capable of producing at least a 1.2 fold increase in expression of SCN1A when bound by an eTF disclosed herein.

In certain embodiments, an eTF disclosed herein that upregulates SCN1A (i) binds to a target site comprising or consisting of any of SEQ ID NOs: 35-37, 101, 105-111, 136, 195-211, 224-238, or 240-267, and (ii) is capable of producing at least a 1.2 fold increase in expression of SCN1A when bound by an eTF disclosed herein.

In certain embodiments, an eTF disclosed herein that upregulates SCN1A recognizes a target binding site that is (i) 18-27 bp, 18 bp, or 27 bp, (ii) overlaps with a position on chromosome 2 selected from 166155255, 166155099, 166148843, 166148361, 166142219, 166141090, 165990246, 165990193, 166149168, 166127991, 166128002, 166128037, or 166128025 (all with reference to GRCh38.p12), and (iii) is capable of producing at least a 2 fold increase in expression of SCN1A when bound by an eTF disclosed herein.

In certain embodiments, an eTF disclosed herein that upregulates SCN1A (i) binds to a target site comprising or consisting of any of SEQ ID NOs: 35-36, 108-109, 136, 209-210, 226, 228, 233, 236, or 247-248, and (ii) is capable of producing at least a 2 fold increase in expression of SCN1A when bound by an eTF disclosed herein.

In certain embodiments, an eTF disclosed herein that upregulates SCN1A recognizes a target binding site that is (i) 18-27 bp, 18 bp, or 27 bp, and (ii) overlaps with a position on chromosome 2 selected from 166149168, 166127991, 166128002, 166128037 or 166128025 (all with reference to GRCh38.p12), and (iii) is capable of producing at least a 5 fold increase in expression of SCN1A when bound by an eTF disclosed herein.

In certain embodiments, an eTF disclosed herein that upregulates SCN1A (i) binds to a target site comprising or consisting of any of SEQ ID NOs: 35, 36, 108, 109, or 136, and (ii) is capable of producing at least a 5 fold increase in expression of SCN1A when bound by an eTF disclosed herein.

In certain embodiments, an eTF disclosed herein that upregulates SCN1A recognizes a target binding site that is (i) 18-27 bp, 18 bp, or 27 bp, (ii) overlaps with a position on chromosome 2 selected from 166128002, 166128037, or 166128025 (all with reference to GRCh38.p12), and (iii) is capable of producing at least a 15 fold increase in expression of SCN1A when bound by an eTF disclosed herein.

In certain embodiments, an eTF disclosed herein that upregulates SCN1A (i) binds to a target site comprising or consisting of any of SEQ ID NOs: 36, 108 or 109, and (ii) is capable of producing at least a 15 fold increase in expression of SCN1A when bound by an eTF disclosed herein.

In certain embodiments, an eTF disclosed herein that upregulates SCN1A recognizes a target binding site that is (i) 18-27 bp, 18 bp, or 27 bp, (ii) overlaps with a position on chromosome 2 selected from 166128037 or 166128025 (all with reference to GRCh38.p12), and (iii) is capable of producing at least a 20 fold increase in expression of SCN1A when bound by an eTF disclosed herein.

In certain embodiments, an eTF disclosed herein that upregulates SCN1A (i) binds to a target site comprising or consisting of any of SEQ ID NOs: 36 or 109, and (ii) is capable of producing at least a 20 fold increase in expression of SCN1A when bound by an eTF disclosed herein.

In certain embodiments, an eTF disclosed herein that upregulates SCN1A recognizes a target binding site that is (i) 18-27 bp, 18 bp, or 27 bp, (ii) overlaps with a position on chromosome 2 at position 166128025, and (iii) is capable of producing at least a 25 fold increase in expression of SCN1A when bound by an eTF disclosed herein.

In certain embodiments, an eTF disclosed herein that upregulates SCN1A (i) binds to a target site comprising or consisting of SEQ ID NOs: 36, and (ii) is capable of producing at least a 25 fold increase in expression of SCN1A when bound by an eTF disclosed herein.

In certain embodiments, an eTF disclosed herein that upregulates SCN1A recognizes a target binding site that is (i) 18-27 bp, 18 bp, or 27 bp, and (ii) binds to a genomic region that is within at least 1 kb, 750 bp, 500 bp, 400 bp, 300 bp, 200 bp, 100 bp, or 50 bp of a genomic location having a sequence of any one of SEQ ID NOs: 35-37, 101, 105-111, 136, 195-211, 224-238, or 240-267. In certain embodiments, the target binding site is capable of producing at least a 1.2 fold, 2 fold, 5 fold, 15 fold, 20 fold, or 25 fold increase in expression of SCN1A when bound by an eTF disclosed herein.

In certain embodiments, an eTF disclosed herein that upregulates SCN1A recognizes a target binding site that is (i) 18-27 bp, 18 bp, or 27 bp, and (ii) binds to a genomic region that is at least partially overlapping with a genomic location having a sequence of any one of SEQ ID NOs: 35-37, 101, 105-111, 136, 195-211, 224-238, or 240-267. In certain embodiments, the target binding site is capable of producing at least a 1.2 fold, 2 fold, 5 fold, 15 fold, 20 fold, or 25 fold increase in expression of SCN1A when bound by an eTF disclosed herein.

In certain embodiments, an eTF disclosed herein that upregulates SCN1A recognizes a target binding site having any one of the following sequences: SEQ ID NOs: 35-37, 101, 105-111, 136, 195-211, 224-238, or 240-267. In certain embodiments, the target binding site is capable of producing at least a 1.2 fold, 2 fold, 5 fold, 15 fold, 20 fold, or 25 fold increase in expression of SCN1A when bound by an eTF disclosed herein.

In certain embodiments, an eTF disclosed herein that upregulates SCN1A results in at least 1.5 fold, 2 fold, 3 fold, 4 fold, 5 fold, 6 fold, 7 fold, 8 fold, 9 fold, 10 fold, 15 fold, 20 fold, 25 fold, 50 fold, 100 fold, or greater, or at least a 50%, 60%, 70%, 75%, 80%, 90%, 100%, 125%, 150%, 200%, 250%, 300%, 400%, or 500% or greater upregulation of SCN1A expression (SCN1A RNA and/or Nav1.1 protein) in a cell or in vivo as compared to a control (e.g., no eTF or an eTF that does not recognize the target site). In various embodiments, upregulation of SCN1A expression can be detected using PCR methods, Western blot, or immunoassays.

In certain embodiments, an eTF disclosed herein that upregulates SCN1A binds to a target site that is capable of increasing SCN1A expression by at least 1.2 fold, 1.3 fold, 1.4 fold, 1.5 fold, 1.6 fold, 1.7 fold, 1.8 fold, 1.9 fold, 2 fold, 3 fold, 4 fold, 5 fold, 8 fold, 10 fold, 12 fold, 15 fold, 18 fold, 20 fold, 25 fold, 30 fold, 40 fold, 50 fold, 75 fold, 100 fold, or greater or by at least 20%, 30%, 40%, 50%, 60%, 70%, 75%, 80%, 90%, 100%, 125%, 150%, 200%, 250%, 300%, 400%, or 500% or greater relative to a control in a transcriptional activation assay. An exemplary SCN1A transcriptional activation assay is provided herein in Example 3. Briefly, HEK293 are transfected with a plasmid carrying an eTF or a control eGFP reporter construct. 48 h following transfection, cells are collected, RNA is isolated, and reverse transcribed and the resulting cDNA samples are analyzed by qPCR (for example, using primers having SEQ ID NOs: 190 and 191) to quantify levels of endogenous SCN1A transcript. GAPDH may be used as a reference gene to determine relative levels of SCN1A expression.

In certain embodiments, an eTF disclosed herein that upregulates SCN1A has minimal off target effects, e.g., off-target effects associated with non-specific binding such as, for example, modulation of expression of an off-target gene or gene other than SCN1A. In one embodiment, an eTF disclosed herein that upregulates SCN1A specifically upregulates SCN1A as compared to a control by at least 5 fold, 10 fold, 15 fold, 20 fold, 25 fold, 30 fold, 40 fold, or 50 fold greater than the expression produced by the eTF for one or more off target genes as compared to a control. In an exemplary embodiment, an eTF disclosed herein that upregulates SCN1A specifically upregulates transcription from the SCN1A gene as compared to a control by at least 15 fold greater than the transcription of the 40 nearest neighbor genes (e.g., the 40 nearest genes located to the coding sequence of SCN1A on chromosome 2) produced by the eTF relative to a control, e.g., PLA2R1, ITGB6, RBMS1, TANK, PSMD14, TBR1, SLC4A10, DPP4, FAP, IFIH1, GCA, FIGN, GRB14, COBLL1, SLC38A11, SCN3A, SCN2A, CSRNP3, GALNT3, TTC21B, SCN9A, SCN7A, B3GALT1, STK39, CERS6, NOSTRIN, SPC25, ABCB11, DHRS9, BBS5, KLHL41, FASTKD1, PPIG, CCDC173, PHOSPHO2, KLHL23, SSB, METTL5, UBR3, and MYO3B (see Table 33). In various embodiments, upregulation of transcription from the SCN1A gene can be detected using PCR methods.

In certain embodiments, an eTF disclosed herein that upregulates SCN1A is capable of reducing the frequency of seizures in a hyperthermic seizure (HTS) assay in the Scn1a$^{tm1kea}$ mouse model of Dravet syndrome. In certain embodiments, an eTF disclosed herein is able to reduce the frequency of seizures at 42.6° C. in an HTS assay by at least 1.2 fold, 1.3 fold, 1.4 fold, 1.5 fold, 1.6 fold, 1.7 fold, 1.8 fold, 1.9 fold, 2.0 fold, or more or by at least 20%, 30% 40%, 50%, 55%, 60%, 65%, 70%, 75%, 80%, 85%, 90%, 95%, 100% or more as compared to a control (e.g., PBS treated or treatment with an AAV vector comprising a sequence encoding eGFP). In certain embodiments, an eTF disclosed herein is able to reduce the frequency of seizures at 42.6° C. in an HTS assay so that at least 60%, 62%, 65%, 70%, 75%, 76%, 80%, 85%, 86%, 87%, 88%, 89%, 90%, 91%, 92%, 93%, 94%, 95%, 96%, 97%, 98% or 99% of the mice run in the assay are seizure free at 42.6° C. An exemplary HTS assay is described herein in Example 11. Briefly, litters of pups produced from male Scn1a +/− mice crossed with female C57Bl/6J mice may be dosed with an AAV9 vector encoding an eTF that upregulates SCN1A as provided herein or a control vector encoding eGFP via bilateral ICV at P1. Mice may be dosed with ~1.0E10-5.0E12 gc/mouse. The HTS assay is performed in P26-P28 SCN1A heterozygous mice and SCN1A wild-type mice in a mixed 129Stac X C57BL/6 background by increasing the body temperature of the mice (under controlled conditions and with body temperature monitoring) by ~0.5° C. every 2 minutes until the onset of the first tonic-clonic seizure accompanied by loss of posture or until a body temperature of 43° C. is reached. A mouse is considered to be seizure free if no seizure with loss of posture is detected over the full course of the experiment.

In certain embodiments, an eTF disclosed herein that upregulates SCN1A is capable of increasing the survival of a mouse that is heterozygous for SCN1A, e.g., an Scn1a$^{tm1kea}$ mouse line. In certain embodiments, an eTF disclosed herein is able to increase the survival rate of SCN1A heterozygous mice at P100 by at least 1.2 fold, 1.3 fold, 1.4 fold, 1.5 fold, 1.6 fold, 1.7 fold, 1.8 fold, 1.9 fold, 2.0 fold, or more or by at least 20%, 30% 40%, 50%, 55%, 60%, 65%, 70%, 75%, 80%, 85%, 90%, 95%, 100% or more as compared to a control (e.g., PBS treated or treatment with an AAV vector comprising a sequence encoding eGFP). In certain embodiments, an eTF disclosed herein is able to increase the survival rate of SCN1A heterozygous mice at P100 so that at least 65%, 70%, 75%, 80%, 85%, 86%, 87%, 88%, 89%, 90%, 91%, 92%, 93%, 94%, 95%, 96%, 97%, 98%, 99% or 100% of the mice run in the assay are still alive at P100. An exemplary survival assay is described herein in Example 12. Briefly, litters of pups produced from male Scn1a +/− mice crossed with female C57Bl/6J mice may be dosed with AAV9 vector via bilateral ICV at P1. Mice may be dosed with ~1.0E10-5.0E12 gc/mouse. The number of mice that have survived to P100 is determined.

In certain embodiments, an eTF disclosed herein that upregulates SCN1A has a high percent identity to one or more human proteins (as further described below). In certain embodiments, such eTFs have at least 75%, 80%, 85%, 86%, 87%, 88%, 89%, 90%, 91%, 92%, 93%, 94%, 95%, 96%, 97%, 98% or 99% overall sequence identity to one or more human proteins. In certain embodiments, such eTFs exhibit reduced immunogenicity as compared to an eTF having a lower overall percent sequence identity to one or more human proteins. In various embodiments, a reduction in immunogenicity can be measured using an elispot assay, an immunoassay, or an in silico method. In certain embodiments, such eTFs may comprise a DBD derived from human EGR1 or EGR3 and a TAD derived from human EGR1, EGR3, CITED2, or CITED4.

In certain embodiments, an eTF disclosed herein that upregulates SCN1A comprises a DNA binding domain having one or more zinc finger domains comprising a recognition helix comprising any one of SEQ ID NOs: 115-130. In certain embodiments, an eTF disclosed herein that upregulates SCN1A comprises a DNA binding domain having at least one, two, three, four, five, six, seven, eight, nine, ten, eleven or twelve zinc finger domains, wherein each zinger finger domain independently comprises a recognition helix comprising any one of SEQ ID NOs: 115-130. In certain embodiments, an eTF disclosed herein that upregulates SCN1A comprises a DNA binding domain having six zinc finger domains, wherein each zinger finger domain independently comprises a recognition helix comprising any one of SEQ ID NOs: 115-130. In certain embodiments, an eTF disclosed herein that upregulates SCN1A comprises a DNA binding domain having nine zinc finger domains, wherein each zinger finger domain independently comprises a recognition helix comprising any one of SEQ ID NOs: 115-130. In exemplary embodiments, such eTFs comprise a DNA binding domain having SEQ ID NO: 421, wherein each X is independently selected from any one of SEQ ID NOs: 115-130, and n is 6 or 9.

In certain embodiments, an eTF disclosed herein that upregulates SCN1A comprises a DNA binding domain having any one of: (i) a sequence comprising RSDNLVR x REDNLHT x RSDELVR x QSGNLTE x TSGHLVR x QNSTLTE (SEQ ID NO: 135), wherein x can be a linker of 1-50 amino acids, (ii) a sequence having at least 80%, 85%, 90%, 95%, 96%, 97%, 98%, or 99% sequence identity to SEQ ID NO: 135, or (ii) a functional fragment of (i) or (ii). In certain embodiments, such an eTF further comprises one or more TADs selected from VP64, VPR, CITED2 or CITED4. In one embodiment, such an eTF comprises a VPR TAD domain conjugated to the C-terminus of the DBD. In certain embodiments, such an eTF comprises a CITED2 TAD conjugated to the N-terminus, the C-terminus, or the N-terminus and C-terminus of the DBD. In certain embodiments, such an eTF comprises a CITED4 TAD conjugated to the N-terminus, the C-terminus, or the N-terminus and C-terminus of the DBD. In certain embodiments, such an eTF is capable of binding to a target site having SEQ ID NO: 256 and upregulating expression of SCN1A by at least 2 fold, 5 fold, 10 fold, 15 fold, 20 fold, 25 fold, 30 fold, 40 fold, 50 fold, or greater as compared to a control, or by at least 20%, 30%, 40%, 50%, 60%, 70%, 75%, 80%, 90%, 100%, 125%, 150%, 200%, 250%, 300%, 400%, or 500% or greater as compared to a control.

In certain embodiments, an eTF disclosed herein that upregulates SCN1A comprises a DNA binding domain having any one of: (i) a sequence comprising RSDNLVR x HRTTLTN x REDNLHT x TSHSLTE x QSSSLVR x REDNLHT (SEQ ID NO: 371), wherein x can be a linker of 1-50 amino acids, (ii) a sequence having at least 80%, 85%, 90%, 95%, 96%, 97%, 98%, or 99% sequence identity to SEQ ID NO: 371, or (ii) a functional fragment of (i) or (ii). In certain embodiments, such an eTF further comprises one or more TADs selected from VP64, VPR, CITED2 or CITED4. In one embodiment, such an eTF comprises a VPR TAD domain conjugated to the C-terminus of the DBD. In certain embodiments, such an eTF comprises a CITED2 TAD conjugated to the N-terminus, the C-terminus, or the N-terminus and C-terminus of the DBD. In certain embodiments, such an eTF comprises a CITED4 TAD conjugated to the N-terminus, the C-terminus, or the N-terminus and C-terminus of the DBD. In certain embodiments, such an eTF is capable of binding to a target site having SEQ ID NO:

264 and upregulating expression of SCN1A by at least 2 fold, 5 fold, 10 fold, 15 fold, 20 fold, 25 fold, 30 fold, 40 fold, 50 fold, or greater as compared to a control, or by at least 20%, 30%, 40%, 50%, 60%, 70%, 75%, 80%, 90%, 100%, 125%, 150%, 200%, 250%, 300%, 400%, or 500% or greater as compared to a control.

In certain embodiments, an eTF disclosed herein that upregulates SCN1A comprises a DNA binding domain having any one of: (i) a sequence comprising RRDELNV x RSDHLTN x RSDDLVR x RSDNLVR x HRTTLTN x REDNLHT x TSHSLTE x QSSSLVR x REDNLHT (SEQ ID NO: 372), (ii) a sequence having at least 80%, 85%, 90%, 95%, 96%, 97%, 98%, or 99% sequence identity to SEQ ID NO: 372, or (ii) a functional fragment of (i) or (ii). In certain embodiments, such an eTF further comprises one or more TADs selected from VP64, VPR, CITED2 or CITED4. In one embodiment, such an eTF comprises a VPR TAD domain conjugated to the C-terminus of the DBD. In certain embodiments, such an eTF comprises a CITED2 TAD conjugated to the N-terminus, the C-terminus, or the N-terminus and C-terminus of the DBD. In certain embodiments, such an eTF comprises a CITED4 TAD conjugated to the N-terminus, the C-terminus, or the N-terminus and C-terminus of the DBD. In certain embodiments, such an eTF is capable of binding to a target site having SEQ ID NO: 37 and upregulating expression of SCN1A by at least 2 fold, 5 fold, 10 fold, 15 fold, 20 fold, 25 fold, 30 fold, 40 fold, 50 fold, or greater as compared to a control, or by at least 20%, 30%, 40%, 50%, 60%, 70%, 75%, 80%, 90%, 100%, 125%, 150%, 200%, 250%, 300%, 400%, or 500% or greater as compared to a control.

In certain embodiments, an eTF disclosed herein that upregulates SCN1A comprises a DNA binding domain having any one of: (i) a sequence comprising DPGALVR x RSDNLVR x QSGDLRR x THLDLIR x TSGNLVR x RSDNLVR (SEQ ID NO: 376), (ii) a sequence having at least 89%, 85%, 90%, 95%, 96%, 97%, 98%, or 99% sequence identity to SEQ ID NO: 376, or (ii) a functional fragment of (i) or (ii). In certain embodiments, such an eTF further comprises one or more TADs selected from VP64, VPR, CITED2 or CITED4. In one embodiment, such an eTF comprises a VPR TAD domain conjugated to the C-terminus of the DBD. In certain embodiments, such an eTF comprises a CITED2 TAD conjugated to the N-terminus, the C-terminus, or the N-terminus and C-terminus of the DBD. In certain embodiments, such an eTF comprises a CITED4 TAD conjugated to the N-terminus, the C-terminus, or the N-terminus and C-terminus of the DBD. In certain embodiments, such an eTF is capable of binding to a target site having SEQ ID NO: 136 and upregulating expression of SCN1A by at least 2 fold, 5 fold, 10 fold, 15 fold, 20 fold, 25 fold, 30 fold, 40 fold, 50 fold, or greater as compared to a control, or by at least 20%, 30%, 40%, 50%, 60%, 70%, 75%, 80%, 90%, 100%, 125%, 150%, 200%, 250%, 300%, 400%, or 500% or greater as compared to a control.

In certain embodiments, an eTF disclosed herein that upregulates SCN1A comprises any one of: (i) a sequence comprising any one of SEQ ID NOs: 6-9, 13-15, 57-58, 61-62, 67-71, 74-75, 268-282, 295-299, 305-325, or 364-366; (ii) a sequence comprising any one of SEQ ID NOs: 22-25, 29-31, 84-85, 88, 90-92, 131-135, 371-372, 376, 391-409, or 423-435; (iii) a sequence comprising at least 80%, 85%, 86%, 87%, 88%, 89%, 90%, 91%, 92%, 93%, 94%, 95%, 96%, 97%, 98% or 99% sequence identity to any of the sequences of (i) or (ii); or (iv) a functional fragment or variant of any of the sequences of (i), (ii) or (iii). In exemplary embodiments, such eTFs are capable of upregulating SCN1A expression by at least at least 2 fold, 5 fold, 10 fold, 15 fold, 20 fold, 25 fold, 30 fold, 40 fold, 50 fold, or greater as compared to a control, or by at least 20%, 30%, 40%, 50%, 60%, 70%, 75%, 80%, 90%, 100%, 125%, 150%, 200%, 250%, 300%, 400%, or 500% or greater as compared to a control.

In certain embodiments, an eTF disclosed herein that upregulates SCN1A comprises any one of: (i) a sequence comprising any one of SEQ ID NOs: 268-282, 305-312, or 365-366; (ii) a sequence comprising any one of SEQ ID NOs:131-135, 371-372, 376, 391-409, or 423-426; (iii) a sequence comprising at least 80%, 85%, 86%, 87%, 88%, 89%, 90%, 91%, 92%, 93%, 94%, 95%, 96%, 97%, 98% or 99% sequence identity to any of the sequences of (i) or (ii); or (iv) a functional fragment or variant of any of the sequences of (i), (ii) or (iii). In exemplary embodiments, such eTFs are capable of upregulating SCN1A expression by at least at least 2 fold, 5 fold, 10 fold, 15 fold, 20 fold, 25 fold, 30 fold, 40 fold, 50 fold, or greater as compared to a control, or by at least 20%, 30%, 40%, 50%, 60%, 70%, 75%, 80%, 90%, 100%, 125%, 150%, 200%, 250%, 300%, 400%, or 500% or greater as compared to a control.

In certain embodiments, an eTF disclosed herein that upregulates SCN1A comprises any one of: (i) a sequence comprising any one of SEQ ID NOs: 6-9, 13-15, 57-58, 61-62, 67-71, 74-75, 295-299, 313-325, or 364; (ii) a sequence comprising any one of SEQ ID NOs: 22-25, 29-31, 84-85, 88, 90-92, or 427-435; (iii) a sequence comprising at least 80%, 85%, 86%, 87%, 88%, 89%, 90%, 91%, 92%, 93%, 94%, 95%, 96%, 97%, 98% or 99% sequence identity to any of the sequences of (i) or (ii); or (iv) a functional fragment or variant of any of the sequences of (i), (ii) or (iii). In exemplary embodiments, such eTFs are capable of upregulating SCN1A expression by at least at least 2 fold, 5 fold, 10 fold, 15 fold, 20 fold, 25 fold, 30 fold, 40 fold, 50 fold, or greater as compared to a control, or by at least 20%, 30%, 40%, 50%, 60%, 70%, 75%, 80%, 90%, 100%, 125%, 150%, 200%, 250%, 300%, 400%, or 500% or greater as compared to a control. In exemplary embodiments, such eTFs have at least at least 75%, 80%, 85%, 86%, 87%, 88%, 89%, 90%, 91%, 92%, 93%, 94%, 95%, 96%, 97%, 98% or 99% overall sequence identity to one or more human proteins. In certain embodiments, such eTFs exhibits reduced immunogenicity as compared to an eTF having a lower overall percent sequence identity to one or more human proteins. In various embodiments, a reduction in immunogenicity can be measured using an elispot assay, an immunoassay, or an in silico method.

In certain embodiments, an eTF disclosed herein that upregulates SCN1A comprises any one of: (i) a sequence comprising SEQ ID NO: 305; (ii) a sequence comprising SEQ ID NO: 423; (iii) a sequence comprising at least 80%, 85%, 86%, 87%, 88%, 89%, 90%, 91%, 92%, 93%, 94%, 95%, 96%, 97%, 98% or 99% sequence identity the sequences of (i) or (ii); or (iv) a functional fragment or variant of any of the sequences of (i), (ii) or (iii). In exemplary embodiments, such eTFs comprise SEQ ID NO: 135 and bind to a target site having SEQ ID NO: 256. In exemplary embodiments, such eTFs are capable of upregulating SCN1A expression by at least at least 2 fold, 5 fold, 10 fold, 15 fold, 20 fold, 25 fold, 30 fold, 40 fold, 50 fold, or greater as compared to a control, or by at least 20%, 30%, 40%, 50%, 60%, 70%, 75%, 80%, 90%, 100%, 125%, 150%, 200%, 250%, 300%, 400%, or 500% or greater as compared to a control.

In certain embodiments, an eTF disclosed herein that upregulates SCN1A comprises any one of: (i) a sequence comprising SEQ ID NO: 306; (ii) a sequence comprising SEQ ID NO: 424; (iii) a sequence comprising at least 80%, 85%, 86%, 87%, 88%, 89%, 90%, 91%, 92%, 93%, 94%, 95%, 96%, 97%, 98% or 99% sequence identity the sequences of (i) or (ii); or (iv) a functional fragment or variant of any of the sequences of (i), (ii) or (iii). In exemplary embodiments, such eTFs comprise SEQ ID NO: 135 and bind to a target site having SEQ ID NO: 256. In exemplary embodiments, such eTFs are capable of upregulating SCN1A expression by at least at least 2 fold, 5 fold, 10 fold, 15 fold, 20 fold, 25 fold, 30 fold, 40 fold, 50 fold, or greater as compared to a control, or by at least 20%, 30%, 40%, 50%, 60%, 70%, 75%, 80%, 90%, 100%, 125%, 150%, 200%, 250%, 300%, 400%, or 500% or greater as compared to a control.

In certain embodiments, an eTF disclosed herein that upregulates SCN1A comprises any one of: (i) a sequence comprising SEQ ID NO: 308; (ii) a sequence comprising SEQ ID NO: 425; (iii) a sequence comprising at least 80%, 85%, 86%, 87%, 88%, 89%, 90%, 91%, 92%, 93%, 94%, 95%, 96%, 97%, 98% or 99% sequence identity the sequences of (i) or (ii); or (iv) a functional fragment or variant of any of the sequences of (i), (ii) or (iii). In exemplary embodiments, such eTFs comprise SEQ ID NO: 135 and bind to a target site having SEQ ID NO: 256. In exemplary embodiments, such eTFs are capable of upregulating SCN1A expression by at least at least 2 fold, 5 fold, 10 fold, 15 fold, 20 fold, 25 fold, 30 fold, 40 fold, 50 fold, or greater as compared to a control, or by at least 20%, 30%, 40%, 50%, 60%, 70%, 75%, 80%, 90%, 100%, 125%, 150%, 200%, 250%, 300%, 400%, or 500% or greater as compared to a control.

In certain embodiments, an eTF disclosed herein that upregulates SCN1A comprises any one of: (i) a sequence comprising SEQ ID NO:313; (ii) a sequence comprising SEQ ID NO: 427; (iii) a sequence comprising at least 80%, 85%, 86%, 87%, 88%, 89%, 90%, 91%, 92%, 93%, 94%, 95%, 96%, 97%, 98% or 99% sequence identity the sequences of (i) or (ii); or (iv) a functional fragment or variant of any of the sequences of (i), (ii) or (iii). In exemplary embodiments, such eTFs comprise SEQ ID NO: 135 and bind to a target site having SEQ ID NO: 256. In exemplary embodiments, such eTFs are capable of upregulating SCN1A expression by at least at least 2 fold, 5 fold, 10 fold, 15 fold, 20 fold, 25 fold, 30 fold, 40 fold, 50 fold, or greater as compared to a control, or by at least 20%, 30%, 40%, 50%, 60%, 70%, 75%, 80%, 90%, 100%, 125%, 150%, 200%, 250%, 300%, 400%, or 500% or greater as compared to a control. In exemplary embodiments, such eTFs have at least at least 75%, 80%, 85%, 86%, 87%, 88%, 89%, 90%, 91%, 92%, 93%, 94%, 95%, 96%, 97%, 98% or 99% overall sequence identity to one or more human proteins. In certain embodiments, such eTFs exhibits reduced immunogenicity as compared to an eTF having a lower overall percent sequence identity to one or more human proteins. In various embodiments, a reduction in immunogenicity can be measured using an elispot assay, an immunoassay, or an in silico method.

In certain embodiments, an eTF disclosed herein that upregulates SCN1A comprises any one of: (i) a sequence comprising SEQ ID NO: 316; (ii) a sequence comprising SEQ ID NO: 430; (iii) a sequence comprising at least 80%, 85%, 86%, 87%, 88%, 89%, 90%, 91%, 92%, 93%, 94%, 95%, 96%, 97%, 98% or 99% sequence identity the sequences of (i) or (ii); or (iv) a functional fragment or variant of any of the sequences of (i), (ii) or (iii). In exemplary embodiments, such eTFs comprise SEQ ID NO: 135 and bind to a target site having SEQ ID NO: 256. In exemplary embodiments, such eTFs are capable of upregulating SCN1A expression by at least at least 2 fold, 5 fold, 10 fold, 15 fold, 20 fold, 25 fold, 30 fold, 40 fold, 50 fold, or greater as compared to a control, or by at least 20%, 30%, 40%, 50%, 60%, 70%, 75%, 80%, 90%, 100%, 125%, 150%, 200%, 250%, 300%, 400%, or 500% or greater as compared to a control. In exemplary embodiments, such eTFs have at least at least 75%, 80%, 85%, 86%, 87%, 88%, 89%, 90%, 91%, 92%, 93%, 94%, 95%, 96%, 97%, 98% or 99% overall sequence identity to one or more human proteins. In certain embodiments, such eTFs exhibits reduced immunogenicity as compared to an eTF having a lower overall percent sequence identity to one or more human proteins. In various embodiments, a reduction in immunogenicity can be measured using an elispot assay, an immunoassay, or an in silico method.

In certain embodiments, an eTF disclosed herein that upregulates SCN1A comprises any one of: (i) a sequence comprising SEQ ID NO: 317; (ii) a sequence comprising SEQ ID NO:431; (iii) a sequence comprising at least 80%, 85%, 86%, 87%, 88%, 89%, 90%, 91%, 92%, 93%, 94%, 95%, 96%, 97%, 98% or 99% sequence identity the sequences of (i) or (ii); or (iv) a functional fragment or variant of any of the sequences of (i), (ii) or (iii). In exemplary embodiments, such eTFs comprise SEQ ID NO: 371 and bind to a target site having SEQ ID NO: 264, In exemplary embodiments, such eTFs are capable of upregulating SCN1A expression by at least at least 2 fold, 5 fold, 10 fold, 15 fold, 20 fold, 25 fold, 30 fold, 40 fold, 50 fold, or greater as compared to a control, or by at least 20%, 30%, 40%, 50%, 60%, 70%, 75%, 80%, 90%, 100%, 125%, 150%, 200%, 250%, 300%, 400%, or 500% or greater as compared to a control. In exemplary embodiments, such eTFs have at least at least 75%, 80%, 85%, 86%, 87%, 88%, 89%, 90%, 91%, 92%, 93%, 94%, 95%, 96%, 97%, 98% or 99% overall sequence identity to one or more human proteins. In certain embodiments, such eTFs exhibits reduced immunogenicity as compared to an eTF having a lower overall percent sequence identity to one or more human proteins. In various embodiments, a reduction in immunogenicity can be measured using an elispot assay, an immunoassay, or an in silico method.

In certain embodiments, an eTF disclosed herein that upregulates SCN1A comprises any one of: (i) a sequence comprising SEQ ID NO:315; (ii) a sequence comprising SEQ ID NO:429; (iii) a sequence comprising at least 80%, 85%, 86%, 8'7%, 88%, 89%, 90%, 91%, 92%, 93%, 94%, 95%, 96%, 97%, 98% or 99% sequence identity the sequences of (i) or (ii); or (iv) a functional fragment or variant of any of the sequences of (i), (ii) or (iii). In exemplary embodiments, such eTFs comprise SEQ ID NO: 135 and bind to a target site having SEQ ID NO: 256. In exemplary embodiments, such eTFs are capable of upregulating SCN1A expression by at least at least 2 fold, 5 fold, 10 fold, 15 fold, 20 fold, 25 fold, 30 fold, 40 fold, 50 fold, or greater as compared to a control, or by at least 20%, 30%, 40%, 50%, 60%, 70%, 75%, 80%, 90%, 100%, 125%, 150%, 200%, 250%, 300%, 400%, or 500% or greater as compared to a control. In exemplary embodiments, such eTFs have at least at least 75%, 80%, 85%, 86%, 87%, 88%, 89%, 90%, 91%, 92%, 93%, 94%, 95%, 96%, 97%, 98% or 99% overall sequence identity to one or more human proteins. In certain embodiments, such eTFs exhibits reduced immunogenicity as compared to an eTF having a lower overall percent sequence identity to one or more human proteins. In various embodiments, a reduction in immunogenicity can be measured using an elispot assay, an immunoassay, or an in silico method.

In certain embodiments, an eTF disclosed herein that upregulates SCN1A comprises any one of: (i) a sequence comprising SEQ ID NO:319; (ii) a sequence comprising SEQ ID NO:433; (iii) a sequence comprising at least 80%, 85%, 86%, 87%, 88%, 89%, 90%, 91%, 92%, 93%, 94%, 95%, 96%, 97%, 98% or 99% sequence identity the sequences of (i) or (ii); or (iv) a functional fragment or variant of any of the sequences of (i), (ii) or (iii). In exemplary embodiments, such eTFs comprise SEQ ID NO: 371 and bind to a target site having SEQ ID NO: 264. In exemplary embodiments, such eTFs are capable of upregulating SCN1A expression by at least at least 2 fold, 5 fold, 10 fold, 15 fold, 20 fold, 25 fold, 30 fold, 40 fold, 50 fold, or greater as compared to a control, or by at least 20%, 30%, 40%, 50%, 60%, 70%, 75%, 80%, 90%, 100%, 125%, 150%, 200%, 250%, 300%, 400%, or 500% or greater as compared to a control. In exemplary embodiments, such eTFs have at least at least 75%, 80%, 85%, 86%, 87%, 88%, 89%, 90%, 91%, 92%, 93%, 94%, 95%, 96%, 97%, 98% or 99% overall sequence identity to one or more human proteins. In certain embodiments, such eTFs exhibits reduced immunogenicity as compared to an eTF having a lower overall percent sequence identity to one or more human proteins. In various embodiments, a reduction in immunogenicity can be measured using an elispot assay, an immunoassay, or an in silico method.

In certain embodiments, an eTF disclosed herein that upregulates SCN1A comprises any one of: (i) a sequence comprising SEQ ID NO: 318; (ii) a sequence comprising SEQ ID NO: 432; (iii) a sequence comprising at least 80%, 85%, 86%, 87%, 88%, 89%, 90%, 91%, 92%, 93%, 94%, 95%, 96%, 97%, 98% or 99% sequence identity the sequences of (i) or (ii); or (iv) a functional fragment or variant of any of the sequences of (i), (ii) or (iii). In exemplary embodiments, such eTFs comprise SEQ ID NO: 371 and bind to a target site having SEQ ID NO: 264. In exemplary embodiments, such eTFs are capable of upregulating SCN1A expression by at least at least 2 fold, 5 fold, 10 fold, 15 fold, 20 fold, 25 fold, 30 fold, 40 fold, 50 fold, or greater as compared to a control, or by at least 20%, 30%, 40%, 50%, 60%, 70%, 75%, 80%, 90%, 100%, 125%, 150%, 200%, 250%, 300%, 400%, or 500% or greater as compared to a control. In exemplary embodiments, such eTFs have at least at least 75%, 80%, 85%, 86%, 87%, 88%, 89%, 90%, 91%, 92%, 93%, 94%, 95%, 96%, 97%, 98% or 99% overall sequence identity to one or more human proteins. In certain embodiments, such eTFs exhibits reduced immunogenicity as compared to an eTF having a lower overall percent sequence identity to one or more human proteins. In various embodiments, a reduction in immunogenicity can be measured using an elispot assay, an immunoassay, or an in silico method.

In certain embodiments, an eTF disclosed herein that upregulates SCN1A comprises any one of: (i) a sequence comprising SEQ ID NO: 314; (ii) a sequence comprising SEQ ID NO: 428; (iii) a sequence comprising at least 80%, 85%, 86%, 87%, 88%, 89%, 90%, 91%, 92%, 93%, 94%, 95%, 96%, 97%, 98% or 99% sequence identity the sequences of (i) or (ii); or (iv) a functional fragment or variant of any of the sequences of (i), (ii) or (iii). In exemplary embodiments, such eTFs comprise SEQ ID NO: 135 and bind to a target site having SEQ ID NO: 256. In exemplary embodiments, such eTFs are capable of upregulating SCN1A expression by at least at least 2 fold, 5 fold, 10 fold, 15 fold, 20 fold, 25 fold, 30 fold, 40 fold, 50 fold, or greater as compared to a control, by at least 20%, 30%, 40%, 50%, 60%, 70%, 75%, 80%, 90%, 100%, 125%, 150%, 200%, 250%, 300%, 400%, or 500% or greater as compared to a control. In exemplary embodiments, such eTFs have at least at least 75%, 80%, 85%, 86%, 87%, 88%, 89%, 90%, 91%, 92%, 93%, 94%, 95%, 96%, 97%, 98% or 99% overall sequence identity to one or more human proteins. In certain embodiments, such eTFs exhibits reduced immunogenicity as compared to an eTF having a lower overall percent sequence identity to one or more human proteins. In various embodiments, a reduction in immunogenicity can be measured using an elispot assay, an immunoassay, or an in silico method.

In certain embodiments, an eTF disclosed herein that upregulates SCN1A comprises any one of: (i) a sequence comprising SEQ ID NO: 440; (ii) a sequence comprising SEQ ID NO: 441; (iii) a sequence comprising at least 80%, 85%, 86%, 87%, 88%, 89%, 90%, 91%, 92%, 93%, 94%, 95%, 96%, 97%, 98% or 99% sequence identity the sequences of (i) or (ii); or (iv) a functional fragment or variant of any of the sequences of (i), (ii) or (iii). In exemplary embodiments, such eTFs comprise SEQ ID NO: 135 and bind to a target site having SEQ ID NO: 256. In exemplary embodiments, such eTFs are capable of upregulating SCN1A expression by at least at least 2 fold, 5 fold, 10 fold, 15 fold, 20 fold, 25 fold, 30 fold, 40 fold, 50 fold, or greater as compared to a control, or by at least 20%, 30%, 40%, 50%, 60%, 70%, 75%, 80%, 90%, 100%, 125%, 150%, 200%, 250%, 300%, 400%, or 500% or greater as compared to a control. In exemplary embodiments, such eTFs have at least at least 75%, 80%, 85%, 86%, 87%, 88%, 89%, 90%, 91%, 92%, 93%, 94%, 95%, 96%, 97%, 98% or 99% overall sequence identity to one or more human proteins. In certain embodiments, such eTFs exhibits reduced immunogenicity as compared to an eTF having a lower overall percent sequence identity to one or more human proteins. In various embodiments, a reduction in immunogenicity can be measured using an elispot assay, an immunoassay, or an in silico method.

In certain embodiments, an eTF disclosed herein that upregulates SCN1A comprises any one of: (i) a sequence comprising SEQ ID NO: 325; (ii) a sequence comprising SEQ ID NO: 435; (iii) a sequence comprising at least 80%, 85%, 86%, 87%, 88%, 89%, 90%, 91%, 92%, 93%, 94%, 95%, 96%, 97%, 98% or 99% sequence identity the sequences of (i) or (ii); or (iv) a functional fragment or variant of any of the sequences of (i), (ii) or (iii). In exemplary embodiments, such eTFs comprise SEQ ID NO: 371 and bind to a target site having SEQ ID NO: 264. In exemplary embodiments, such eTFs are capable of upregulating SCN1A expression by at least at least 2 fold, 5 fold, 10 fold, 15 fold, 20 fold, 25 fold, 30 fold, 40 fold, 50 fold, or greater as compared to a control, or by at least 20%, 30%, 40%, 50%, 60%, 70%, 75%, 80%, 90%, 100%, 125%, 150%, 200%, 250%, 300%, 400%, or 500% or greater as compared to a control. In exemplary embodiments, such eTFs have at least at least 75%, 80%, 85%, 86%, 87%, 88%, 89%, 90%, 91%, 92%, 93%, 94%, 95%, 96%, 97%, 98% or 99% overall sequence identity to one or more human proteins. In certain embodiments, such eTFs exhibits reduced immunogenicity as compared to an eTF having a lower overall percent sequence identity to one or more human proteins. In various embodiments, a reduction in immunogenicity can be measured using an elispot assay, an immunoassay, or an in silico method.

In certain embodiments, an eTF disclosed herein that upregulates SCN1A comprises a DBD comprising a gRNA/

Cas complex, wherein the gRNA comprises a targeting sequence comprising any one of SEQ ID NOs: 105-111, 113, 195-211, 224-238, or 240-251. The target sequence of the gRNA is attached to the 5' end of a scaffold sequence having the sequence: 5'-GTTTTAGTACTCTGGAAACAGAATC-TACTAAAACAAGGCAAAATGCCGTGTTTATCTCG TCAACTTGTTGGCGAGA-3' (SEQ ID NO: 102). In exemplary embodiments, the Cas protein is a nuclease deactivated Cas9 protein. In certain embodiments, such an eTF further comprises one or more TADs conjugated to the Cas protein, wherein the TAD is selected from VP64, VPR, CITED2 or CITED4. In one embodiment, such an eTF comprises a VPR TAD domain conjugated to the C-terminus of the Cas protein. In certain embodiments, such an eTF comprises a CITED2 TAD conjugated to the N-terminus, the C-terminus, or the N-terminus and C-terminus of the Cas protein. In certain embodiments, such an eTF comprises a CITED4 TAD conjugated to the N-terminus, the C-terminus, or the N-terminus and C-terminus of the Cas protein. In exemplary embodiments, such eTFs are capable of upregulating SCN1A expression by at least at least 2 fold, 5 fold, 10 fold, 15 fold, 20 fold, 25 fold, 30 fold, 40 fold, 50 fold, or greater as compared to a control.

eTFs that Upregulate Progranulin (GRN)

In another aspect, the application provides eTFs that are capable of upregulating expression from the progranulin (GRN) gene and increasing expression of the GRN protein. Progranulin (GRN or PGRN), also known as granulins precursor, is a cysteine-rich, secreted glycoprotein with growth factor-like properties. GRN is located on chromosome 17q21.31 (NCBI Reference Sequence: NC 000017.11). Granulins play a role in angiogenesis, wound repair, cell proliferation, and inflammation. Mutations in the progranulin gene and/or deficiency in secreted progranulin are associated with various neurodegenerative diseases and metabolic diseases, such as frontotemporal lobar degeneration; frontotemporal degeneration or frontotemporal dementia, an early-onset neurodegenerative disease associated with partial progranulin deficiency; progressive non-fluent aphasia; semantic dementia; Parkinson's disease; Alzheimer's disease; and neuronal ceroid lipofuscinoisis with total deficiency in progranulin. Mutation and/or deficiency in progranulin has also been linked to atherosclerosis, a progressive disease characterized by inflammation and thickening of the arterial walls due to accumulation of lipids and cell proliferation. Thus, an eTF provided herein that increases expression of GRN can be used to treat a variety of disease or disorders associated with mutations in GRN.

In certain embodiments, an eTF disclosed herein that upregulates GRN recognizes a target binding site that is at least 9 bp, 12 bp, 15 bp, 18 bp, 21 bp, 24 bp, 27 bp, 30 bp, 33 bp, or 36 bp in size; more than 9 bp, 12 bp, 15 bp, 18 bp, 21 bp, 24 bp, 27 bp, or 30 bp; or from 9-33 bp, 9-30 bp, 9-27 bp, 9-24 bp, 9-21 bp, 9-18 bp, 9-15 bp, 9-12 bp, 12-33 bp, 12-30 bp, 12-27 bp, 12-24 bp, 12-21 bp, 12-18 bp, 12-15 bp, 15-33 bp, 15-30 bp, 15-27 bp, 15-24 bp, 15-21 bp, 15-18 bp, 18-33 bp, 18-30 bp, 18-27 bp, 18-24 bp, 18-21 bp, 21-33 bp, 21-30 bp, 21-27 bp, 21-24 bp, 24-33 bp, 24-30 bp, 24-27 bp, 27-33 bp, 27-30 bp, or 30-33 bp. In exemplary embodiments, an eTF disclosed herein that upregulates GRN recognizes a target binding site that is 18-27 bp, 18 bp, or 27 bp.

In certain embodiments, an eTF disclosed herein that upregulates GRN recognizes a target binding site that is located on chromosome 17. In certain embodiments, an eTF disclosed herein that upregulates GRN recognizes a target binding site that is located on chromosome 17 within 110 kb, 100 kb, 90 kb, 80 kb, 70 kb, 60 kb, 50 kb, 40 kb, 30 kb, 20 kb, 10 kb, 5 kb, 4 kb, 3 kb, 2 kb, or 1 kb upstream or downstream of the TSS of GRN. In exemplary embodiments, such target binding sites are 18-27 bp, 18 bp, or 27 bp.

In certain embodiments, an eTF disclosed herein that upregulates GRN recognizes a target binding site that is at located on chromosome 17 within positions 44,344,963-44,345,178 (with reference to GRCh38.p12). In exemplary embodiments, such target binding sites are 18-27 bp, 18 bp, or 27 bp.

In certain embodiments, an eTF disclosed herein that upregulates GRN recognizes a target binding site that is (i) 18-27 bp, 18 bp, or 27 bp, and (ii) binds to a genomic region that is within at least 1 kb, 750 bp, 500 bp, 400 bp, 300 bp, 200 bp, 100 bp, or 50 bp of a genomic location having a sequence of any one of SEQ ID NOs: 38, 113, or 330-336. In certain embodiments, the target binding site is capable of producing at least a 1.2 fold, 2 fold, 5 fold, 15 fold, 20 fold, or 25 fold increase in expression of GRN when bound by an eTF disclosed herein.

In certain embodiments, an eTF disclosed herein that upregulates GRN recognizes a target binding site that is (i) 18-27 bp, 18 bp, or 27 bp, and (ii) binds to a genomic region that is at least partially overlapping with a genomic location having a sequence of any one of SEQ ID NOs: 38, 113, or 330-336. In certain embodiments, the target binding site is capable of producing at least a 1.2 fold, 2 fold, 5 fold, 15 fold, 20 fold, or 25 fold increase in expression of SCN1A when bound by an eTF disclosed herein.

In certain embodiments, an eTF disclosed herein that upregulates GRN recognizes a target binding site having any one of the following sequences: SEQ ID NOs: 38, 113, 330-336. In certain embodiments, the target binding site is capable of producing at least a 1.2 fold, 2 fold, 5 fold, 15 fold, 20 fold, or 25 fold increase in expression of SCN1A when bound by an eTF disclosed herein.

In certain embodiments, an eTF disclosed herein that upregulates GRN results in at least 1.5 fold, 2 fold, 3 fold, 4 fold, 5 fold, 6 fold, 7 fold, 8 fold, 9 fold, 10 fold, 15 fold, 20 fold, 25 fold, 50 fold, 100 fold, or greater, or 20%, 30%, 40%, 50%, 60%, 70%, 75%, 80%, 90%, 100%, 125%, 150%, 200%, 250%, 300%, 400%, or 500%, or greater upregulation of GRN expression (GRN RNA and/or protein) in a cell or in vivo as compared to a control (e.g., no eTF or an eTF that does not recognize the target site). In various embodiments, upregulation of GRN expression can be detected using PCR methods, Western blot, or immunoassays.

In certain embodiments, an eTF disclosed herein that upregulates GRN has minimal off target effects, e.g., off-target effects associated with non-specific binding such as, for example, modulation of expression of an off-target gene or gene other than GRN. In one embodiment, an eTF disclosed herein that upregulates GRN specifically upregulates GRN as compared to a control by at least 5 fold, 10 fold, 15 fold, 20 fold, 25 fold, 30 fold, 40 fold, or 50 fold greater than the expression produced by the eTF for one or more off target genes as compared to a control. In an exemplary embodiment, an eTF disclosed herein that upregulates GRN specifically upregulates transcription from the GRN gene as compared to a control by at least 5 fold, 10 fold, 15 fold, 20 fold or greater than the transcription of the 10, 20, 30, 40 or 50 nearest neighbor genes (e.g., the 10, 20, 30, 40 or 50 nearest genes located to the coding sequence of GRN on chromosome 17) produced by the eTF relative to a control. In various embodiments, upregulation of transcription from the GRN gene can be detected using PCR methods.

In certain embodiments, an eTF disclosed herein that upregulates GRN has a high percent identity to one or more human proteins (as further described below). In certain embodiments, such eTFs have at least 75%, 80%, 85%, 86%, 87%, 88%, 89%, 90%, 91%, 92%, 93%, 94%, 95%, 96%, 97%, 98% or 99% overall sequence identity to one or more human proteins. In certain embodiments, such eTFs exhibits reduced immunogenicity as compared to an eTF having a lower overall percent sequence identity to one or more human proteins. In various embodiments, a reduction in immunogenicity can be measured using an elispot assay, an immunoassay, or an in silico method. In certain embodiments, such eTFs may comprise a DBD derived from human EGR1 or EGR3 and a TAD derived from human EGR1, EGR3, CITED2, or CITED4.

In certain embodiments, an eTF disclosed herein that upregulates GRN comprises a DNA binding domain having one or more zinc finger domains comprising a recognition helix comprising any one of SEQ ID NOs: 141-164. In certain embodiments, an eTF disclosed herein that upregulates GRN comprises a DNA binding domain having at least one, two, three, four, five, six, seven, eight, nine, ten, eleven or twelve zinc finger domains, wherein each zinger finger domain independently comprises a recognition helix comprising any one of SEQ ID NOs: 141-164. In certain embodiments, an eTF disclosed herein that upregulates GRN comprises a DNA binding domain having six zinc finger domains, wherein each zinger finger domain independently comprises a recognition helix comprising any one of SEQ ID NOs: 141-164. In certain embodiments, an eTF disclosed herein that upregulates GRN comprises a DNA binding domain having nine zinc finger domains, wherein each zinger finger domain independently comprises a recognition helix comprising any one of SEQ ID NOs: 141-164. In exemplary embodiments, such eTFs comprise a DNA binding domain having SEQ ID NO: 421, wherein each X is independently selected from any one of SEQ ID NOs: 141-164, and n is 6 or 9.

In certain embodiments, an eTF disclosed herein that upregulates GRN comprises a DNA binding domain having any one of: (i) a sequence comprising RNDTLTE x DPGALVR x TSGELVR x RSDNLVR x TSGELVR x TKNSLTE (SEQ ID NO: 171), (ii) a sequence having at least 89%, 85%, 90%, 95%, 96%, 97%, 98%, or 99% sequence identity to SEQ ID NO: 171, or (ii) a functional fragment of (i) or (ii). In certain embodiments, such an eTF further comprises one or more TADs selected from VP64, VPR, CITED2 or CITED4. In one embodiment, such an eTF comprises a VPR TAD domain conjugated to the C-terminus of the DBD. In certain embodiments, such an eTF comprises a CITED2 TAD conjugated to the N-terminus, the C-terminus, or the N-terminus and C-terminus of the DBD. In certain embodiments, such an eTF comprises a CITED4 TAD conjugated to the N-terminus, the C-terminus, or the N-terminus and C-terminus of the DBD. In certain embodiments, such an eTF is capable of binding to a target site having SEQ ID NO: 331 and upregulating expression of GRN by at least 2 fold, 5 fold, 10 fold, 15 fold, 20 fold, 25 fold, 30 fold, 40 fold, 50 fold, or greater as compared to a control, or by at least 20%, 30%, 40%, 50%, 60%, 70%, 75%, 80%, 90%, 100%, 125%, 150%, 200%, 250%, 300%, 400%, or 500% or greater as compared to a control.

In certain embodiments, an eTF disclosed herein that upregulates GRN comprises a DNA binding domain having any one of: (i) a sequence comprising RSDNLVR x DPGHLVR x RSDHLTT x RSDELVR x RSDKLVR x TTGNLTV (SEQ ID NO: 412), (ii) a sequence having at least 89%, 85%, 90%, 95%, 96%, 97%, 98%, or 99% sequence identity to SEQ ID NO: 412, or (ii) a functional fragment of (i) or (ii). In certain embodiments, such an eTF further comprises one or more TADs selected from VP64, VPR, CITED2 or CITED4. In one embodiment, such an eTF comprises a VPR TAD domain conjugated to the C-terminus of the DBD. In certain embodiments, such an eTF comprises a CITED2 TAD conjugated to the N-terminus, the C-terminus, or the N-terminus and C-terminus of the DBD. In certain embodiments, such an eTF comprises a CITED4 TAD conjugated to the N-terminus, the C-terminus, or the N-terminus and C-terminus of the DBD. In certain embodiments, such an eTF is capable of binding to a target site having SEQ ID NO: 332 and upregulating expression of GRN by at least 2 fold, 5 fold, 10 fold, 15 fold, 20 fold, 25 fold, 30 fold, 40 fold, 50 fold, or greater as compared to a control, or by at least 20%, 30%, 40%, 50%, 60%, 70%, 75%, 80%, 90%, 100%, 125%, 150%, 200%, 250%, 300%, 400%, or 500% or greater as compared to a control.

In certain embodiments, an eTF disclosed herein that upregulates GRN comprises a DNA binding domain having any one of: (i) a sequence comprising RSDHLTT x RSDELVR x RSDKLVR x TTGNLTV x QLAHLRA x TKNSLTE (SEQ ID NO: 413), (ii) a sequence having at least 89%, 85%, 90%, 95%, 96%, 97%, 98%, or 99% sequence identity to SEQ ID NO: 413, or (ii) a functional fragment of (i) or (ii). In certain embodiments, such an eTF further comprises one or more TADs selected from VP64, VPR, CITED2 or CITED4. In one embodiment, such an eTF comprises a VPR TAD domain conjugated to the C-terminus of the DBD. In certain embodiments, such an eTF comprises a CITED2 TAD conjugated to the N-terminus, the C-terminus, or the N-terminus and C-terminus of the DBD. In certain embodiments, such an eTF comprises a CITED4 TAD conjugated to the N-terminus, the C-terminus, or the N-terminus and C-terminus of the DBD. In certain embodiments, such an eTF is capable of binding to a target site having SEQ ID NO: 333 and upregulating expression of GRN by at least 2 fold, 5 fold, 10 fold, 15 fold, 20 fold, 25 fold, 30 fold, 40 fold, 50 fold, or greater as compared to a control, or by at least 20%, 30%, 40%, 50%, 60%, 70%, 75%, 80%, 90%, 100%, 125%, 150%, 200%, 250%, 300%, 400%, or 500% or greater as compared to a control.

In certain embodiments, an eTF disclosed herein that upregulates GRN comprises a DNA binding domain having any one of: (i) a sequence comprising SPADLTR x DSGNLRV x QLAHLRA x QRANLRA x REDNLHT x RSDNLVR (SEQ ID NO: 414), (ii) a sequence having at least 89%, 85%, 90%, 95%, 96%, 97%, 98%, or 99% sequence identity to SEQ ID NO: 414, or (ii) a functional fragment of (i) or (ii). In certain embodiments, such an eTF further comprises one or more TADs selected from VP64, VPR, CITED2 or CITED4. In one embodiment, such an eTF comprises a VPR TAD domain conjugated to the C-terminus of the DBD. In certain embodiments, such an eTF comprises a CITED2 TAD conjugated to the N-terminus, the C-terminus, or the N-terminus and C-terminus of the DBD. In certain embodiments, such an eTF comprises a CITED4 TAD conjugated to the N-terminus, the C-terminus, or the N-terminus and C-terminus of the DBD. In certain embodiments, such an eTF is capable of binding to a target site having SEQ ID NO: 38 and upregulating expression of GRN by at least 2 fold, 5 fold, 10 fold, 15 fold, 20 fold, 25 fold, 30 fold, 40 fold, 50 fold, or greater as compared to a control, or by at least 20%, 30%, 40%, 50%, 60%, 70%, 75%, 80%, 90%, 100%, 125%, 150%, 200%, 250%, 300%, 400%, or 500% or greater as compared to a control.

In certain embodiments, an eTF disclosed herein that upregulates GRN comprises a DNA binding domain having any one of: (i) a sequence comprising TSHSLTE x HKNALQN x ERSHLRE x SKKALTE x QRANLRA x RKDNLKN x QSSNLVR x QSSSLVR x QAGHLAS (SEQ ID NO: 415), (ii) a sequence having at least 89%, 85%, 90%, 95%, 96%, 97%, 98%, or 99% sequence identity to SEQ ID NO: 415, or (ii) a functional fragment of (i) or (ii). In certain embodiments, such an eTF further comprises one or more TADs selected from VP64, VPR, CITED2 or CITED4. In one embodiment, such an eTF comprises a VPR TAD domain conjugated to the C-terminus of the DBD. In certain embodiments, such an eTF comprises a CITED2 TAD conjugated to the N-terminus, the C-terminus, or the N-terminus and C-terminus of the DBD. In certain embodiments, such an eTF comprises a CITED4 TAD conjugated to the N-terminus, the C-terminus, or the N-terminus and C-terminus of the DBD. In certain embodiments, such an eTF is capable of binding to a target site having SEQ ID NO: 334 and upregulating expression of GRN by at least 2 fold, 5 fold, 10 fold, 15 fold, 20 fold, 25 fold, 30 fold, 40 fold, 50 fold, or greater as compared to a control, or by at least 20%, 30%, 40%, 50%, 60%, 70%, 75%, 80%, 90%, 100%, 125%, 150%, 200%, 250%, 300%, 400%, or 500% or greater as compared to a control.

In certain embodiments, an eTF disclosed herein that upregulates GRN comprises a DNA binding domain having any one of: (i) a sequence comprising QSGDLRR x SPADLTR x DSGNLRV x QLAHLRA x QRANLRA x REDNLHT x RSDNLVR (SEQ ID NO: 416), (ii) a sequence having at least 89%, 85%, 90%, 95%, 96%, 97%, 98%, or 99% sequence identity to SEQ ID NO: 416, or (ii) a functional fragment of (i) or (ii). In certain embodiments, such an eTF further comprises one or more TADs selected from VP64, VPR, CITED2 or CITED4. In one embodiment, such an eTF comprises a VPR TAD domain conjugated to the C-terminus of the DBD. In certain embodiments, such an eTF comprises a CITED2 TAD conjugated to the N-terminus, the C-terminus, or the N-terminus and C-terminus of the DBD. In certain embodiments, such an eTF comprises a CITED4 TAD conjugated to the N-terminus, the C-terminus, or the N-terminus and C-terminus of the DBD. In certain embodiments, such an eTF is capable of binding to a target site having SEQ ID NO: 335 and upregulating expression of GRN by at least 2 fold, 5 fold, 10 fold, 15 fold, 20 fold, 25 fold, 30 fold, 40 fold, 50 fold, or greater as compared to a control, or by at least 20%, 30%, 40%, 50%, 60%, 70%, 75%, 80%, 90%, 100%, 125%, 150%, 200%, 250%, 300%, 400%, or 500% or greater as compared to a control.

In certain embodiments, an eTF disclosed herein that upregulates GRN comprises any one of: (i) a sequence comprising any one of SEQ ID NOs: 10, 16, 59-60, 63-64, 72-73, 76-77, or 337-350; (ii) a sequence comprising any one of SEQ ID NOs: 26, 32, 86-89, 93, 165-171, 377-390, or 412-416; (iii) a sequence comprising at least 80%, 85%, 86%, 87%, 88%, 89%, 90%, 91%, 92%, 93%, 94%, 95%, 96%, 97%, 98% or 99% sequence identity to any of the sequences of (i) or (ii); or (iv) a functional fragment or variant of any of the sequences of (i), (ii) or (iii). In exemplary embodiments, such eTFs are capable of upregulating GRN expression by at least at least 2 fold, 5 fold, 10 fold, 15 fold, 20 fold, 25 fold, 30 fold, 40 fold, 50 fold, or greater as compared to a control, or by at least 20%, 30%, 40%, 50%, 60%, 70%, 75%, 80%, 90%, 100%, 125%, 150%, 200%, 250%, 300%, 400%, or 500% or greater as compared to a control.

In certain embodiments, an eTF disclosed herein that upregulates GRN comprises a DBD comprising a gRNA/Cas complex, wherein the gRNA comprises a targeting sequence comprising SEQ ID NO: 113. The target sequence of the gRNA is attached to the 5' end of a scaffold sequence having the sequence: 5'-GTTTTAGTACTCTG-GAAACAGAATC-TACTAAAACAAGGCAAAATGCCGTGTTTATCTCG TCAACTTGTTGGCGAGA-3' (SEQ ID NO: 102). In exemplary embodiments, the Cas protein is a nuclease deactivated Cas9 protein. In certain embodiments, such an eTF further comprises one or more TADs conjugated to the Cas protein, wherein the TAD is selected from VP64, VPR, CITED2 or CITED4. In one embodiment, such an eTF comprises a VPR TAD domain conjugated to the C-terminus of the Cas protein. In certain embodiments, such an eTF comprises a CITED2 TAD conjugated to the N-terminus, the C-terminus, or the N-terminus and C-terminus of the Cas protein. In certain embodiments, such an eTF comprises a CITED4 TAD conjugated to the N-terminus, the C-terminus, or the N-terminus and C-terminus of the Cas protein. In exemplary embodiments, such eTFs are capable of upregulating GRN expression by at least at least 2 fold, 5 fold, 10 fold, 15 fold, 20 fold, 25 fold, 30 fold, 40 fold, 50 fold, or greater as compared to a control, or by at least 20%, 30%, 40%, 50%, 60%, 70%, 75%, 80%, 90%, 100%, 125%, 150%, 200%, 250%, 300%, 400%, or 500% or greater as compared to a control.

eTFs that are Highly Homologous to Human Proteins

In another aspect, the application provides eTFs having a high percent sequence identity to one or more human proteins that can be designed to bind to a genomic target site and modulate expression (upregulation or downregulation) of any gene of interest, including, for example, SCN1A or GRN. Such eTFs have little to no immunogenicity when administered to a subject or have reduced immunogenicity as compared to eTFs having lower percent identity to human protein sequences.

In certain embodiments, an eTF provided herein has at least 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to one or more human proteins. When an eTF provided herein comprises a DBD and a TAD derived from the same protein, the percent identity to a human protein may be determined by calculating the total number of amino acid residues in the eTF that match the human protein from which it was derived (e.g., EGR1 or EGR3), divided by the total number of amino acid residues in the eTF. When an eTF provided comprises a DBD from one human protein and a TAD derived from a different human protein, the percent identity to human may be determined by separately calculating the percent identity to human of each domain and summing the two together, e.g., (i) calculating the total number of amino acid residues in the DBD that match the human protein from which it was derived (e.g., EGR1 or EGR3), divided by the total number of amino acid residues in the eTF; (ii) calculating the total number of amino acid residues in the TAD that match the human protein from which it was derived (e.g., CITED2 or CITED4), divided by the total number of amino acid residues in the eTF; and (iii) summing the total of (i) and (ii). In such an embodiment, the domains are divided as follows: the first domain runs from the N-terminus of the eTF through the start of the coding sequence for the second domain, and the second domain runs from the start of the coding sequence for the second domain through the C-terminus of the eTF (e.g., for an eTF having the configuration NLS-DBD-linker-NLS-TAD, the first domain would be NLS-DBD-linker and the second domain would be NLS-TAD). When an eTF provided herein comprises a DBD from one human protein and two TADs derived from one or more different human protein, the percent identity to human may be determined by separately calculating the percent identity to human of each domain and summing all the three together, e.g., (i) calculating the total number of amino acid residues in the DBD that match the human protein from which it was derived (e.g., EGR1 or EGR3), divided by the total number of amino acid residues in the eTF; (ii) calculating the total number of amino acid residues in the first TAD that match the human protein from which it was derived (e.g., CITED2 or CITED4), divided by the total number of amino acid residues in the eTF; (iii) calculating the total number of amino acid residues in the second TAD that match the human protein from which it was derived (e.g., CITED2 or CITED4), divided by the total number of amino acid residues in the eTF; and (iv) summing the total of (i), (ii) and (iii). In such an embodiment, the domains are divided as follows: the first domain runs from the N-terminus of the eTF through the start of the coding sequence for the second domain, the second domain runs from the start of the coding sequence for the second domain through the start of the coding sequence for the third domain, and the third domain runs from the start of the coding sequence for the third domain through the C-terminus of the eTF (e.g., for an eTF having the configuration NLS-TAD1-linker-NLS-DBD-linker-NLS-TAD2, the first domain would be NLS-TAD1-linker, the second domain would be NLS-DBD-linker, and the third domain would be NLS-TAD2). The percent identity to one or more human proteins as described in this section may be determined using the percent identity output obtained using the standard protein BLAST tool available from the NCBI (e.g., the blastp suite alignment tool, using the blastp (protein->protein) algorithm with default parameters) available on the world wide web from the NCBI website at blast.ncbi.nlm.nih.gov/.

In certain embodiments, an eTF provided herein has the benefit of eliciting little, minimal, or no adverse immune response in a human subject due to a high degree of sequence identity to naturally occurring human proteins. In certain embodiments, an eTF provided herein elicits reduced immunogenicity, e.g., at least a 0.5, 1, 1.5, 2, 2.5, 3, 3.5, 4, 4.5, 5, 10, 15, 20, 25, 30, 35, 40, 45, or 50 fold or greater fold reduction in immunogenicity as compared to the immunogenicity observed with an eTF comprising a lower percent identity to one or more human proteins, e.g., an eTF comprising less than 50%, 55%, 65%, or 70% sequence identity to one or more human proteins. In some cases, reduction in immunogenicity can be measured using an elispot assay, an immunoassay, or an in silico method. A gene therapy having a low or minimal immunogenicity has several advantages, including improved patient tolerance, decreased dosage needed to achieve a therapeutic effect, prolonged therapeutic effects after one administration, ability to be administered multiple times or in multiple doses as needed, sustained therapeutic efficacy over a longer period of time per administration, increased safety, and/or increased effectiveness of a gene therapy.

In certain embodiments, the eTFs provided herein having a high percent sequence identity to one or more human proteins comprises a DBD and a TAD derived from one or more naturally occurring human proteins. In certain embodiments, such eTF may comprise a DBD derived from any naturally occurring human protein comprising a DBD. In exemplary embodiments, an eTF provided herein having a high percent sequence identity to one or more human proteins comprises a DBD derived from a naturally occurring zinc finger protein, such as, for example, any one of the zinc finger proteins listed in Table 7. In certain embodiments, an eTF provided herein having a high percent sequence identity to one or more human proteins comprises a DBD derived from a human EGR protein, such as EGR1, EGR2, EGR3, or EGR4. In exemplary embodiments, an eTF provided herein having a high percent sequence identity to one or more human proteins comprises a DBD derived from a human EGR1 or EGR3. In various embodiments, an eTF provided herein having a high percent sequence identity to one or more human proteins comprises a DBD derived from a human zinc finger protein wherein minimal amino acid changes (e.g., 1, 2, 3, 4, 5, 6, 7, or 1-2, 1-3, 1-4, 1-5, 1-6, 1-7, 2-3, 2-4, 2-5, 2-6, 2-7, 3-4, 3-5, 36, or 3-7 amino acid changes) have been made in one or more zinc finger domains of the DBD to alter the binding specificity of the DBD to recognize a target binding site of interest. Such sequence modifications are preferably made in the recognition helices of the zinc finger domains of the DBD, while the rest of the human zinc finger DBD or protein (including the TAD) remains unmodified so as to preserve as much sequence identity to the naturally occurring human protein as possible.

In certain embodiments, the eTFs provided herein having a high percent sequence identity to one or more human proteins comprises one or more transcriptional modulation domains (e.g., a TAD or TRD) derived from a human protein conjugated to a DBD derived from a human protein. In various embodiments, the transcriptional modulation domain may be derived from any naturally occurring human protein having a domain capable of recruiting one or more protein factors that can modulate transcription (e.g., RNA polymerase II, a co-activator protein, or a co-repressor protein) or the level of gene expression from a gene of interest when the eTF is bound to a target site via the DBD. In exemplary embodiments, the TAD is derived from a human EGR protein, such as for example, human EGR1, EGR2, EGR3 or EGR4, or a human cited protein, such as for example, a human CITED2 or CITED4 protein. In an exemplary embodiment, an eTF provided herein having a high percent sequence identity to one or more human proteins comprises a TAD from a human EGR1 or EGR3 protein. In another exemplary embodiment, an eTF provided herein having a high percent sequence identity to one or more human proteins comprises a TAD from a human CITED2 or CITED4 protein.

In one embodiment, an eTF provided herein having a high percent sequence identity to one or more human proteins may comprise a human DBD (hDBD) and a human TAD (hTAD) (e.g., hTAD-hDBD or hDBD-hTAD), wherein the hDBD and hTAD may be derived from the same human protein or from human different proteins. In another embodiment, an eTF provided herein having a high percent sequence identity to one or more human proteins may comprise a hDBD and two hTADs, wherein the hDBD and hTADs are derived from the same human protein, the hDBD is derived from a first human protein and both hTADs are derived from a second human protein, the hDBD and one hTAD are derived from a first human protein and the second hTAD is derived from a second human protein, or the hDBD is derived from a first human protein, one hTAD is derived from a second human protein, and the second hTAD is derived from a third human protein (e.g., hTAD1-hDBD-hTAD1 or hTAD1-hDBD-hTAD2).

In exemplary embodiments, an eTF provided herein having a high percent sequence identity to one or more human proteins comprises any one of the following configurations: (i) a hDBD and a hTAD both derived from human EGR1; (ii) a hDBD and a hTAD both derived from human EGR3; (iii) a hDBD derived from human EGR1 and a hTAD derived from CITED2 (e.g., hEGR1 DBD-hCITED2 TAD or hCITED2 TAD-hEGR1 DBD); (iv) a hDBD derived from human EGR1 and a hTAD derived from human CITED4 (e.g., hEGR1 DBD-hCITED4 TAD or hCITED4 TAD-hEGR1 DBD); (v) a hDBD derived from human EGR3 and a hTAD derived from CITED2 (e.g., hEGR3 DBD-hCITED2 TAD or hCITED2 TAD-hEGR3 DBD); (vi) a hDBD derived from human EGR3 and a hTAD derived from human CITED4 (e.g., hEGR3 DBD-hCITED4 TAD or hCITED4 TAD-hEGR3 DBD); (vii) a hDBD derived from human EGR1 and two hTADs derived from CITED2 (e.g., hCITED2 TAD-hEGR1 DBD-hCITED2 TAD); (viii) a hDBD derived from human EGR1 and two hTADs derived from human CITED4 (e.g., hCITED4 TAD-hEGR1 DBD-hCITED4 TAD); (ix) a hDBD derived from human EGR3 and two hTADs derived from human CITED2 (e.g., hCITED2 TAD-hEGR3 DBD-hCITED2 TAD); (x) a hDBD derived from human EGR3 and two hTADs derived from human CITED4 (e.g., hCITED4 TAD-hEGR3 DBD-hCITED4 TAD); (xi) a hDBD derived from human EGR1, a first hTAD derived from human CITED2, a second hTAD derived from human CITED4 (e.g., hCITED2 TAD-hEGR1 DBD-hCITED4 TAD or hCITED4 TAD-hEGR1 DBD-hCITED2 TAD); or (xii) a hDBD derived from human EGR3, a first hTAD derived from human CITED2, a second hTAD derived from human CITED4 (e.g., hCITED2 TAD-hEGR3 DBD-hCITED4 TAD or hCITED4 TAD-hEGR3 DBD-hCITED2 TAD).

In another embodiment, an eTF provided herein having a high percent sequence identity to one or more human proteins may comprise a hDBD and a hTRD (e.g., hTRD-hDBD or hDBD-hTRD), wherein the hDBD and hTRD may be derived from the same protein or from different proteins. In another embodiment, an eTF provided herein having a high percent sequence identity to one or more human proteins may comprise a hDBD and two hTRDs, wherein the hDBD and hTRDs are derived from the same human protein, the hDBD is derived from a first human protein and both hTRDs are derived from a second human protein, the hDBD and one hTRD are derived from a first human protein and the second hTRD is derived from a second human protein, or the hDBD is derived from a first human protein, one hTRD is derived from a second human protein, and the second hTRD is derived from a third human protein (e.g., hTRD1-hDBD-hTRD1 or hTRD1-hDBD-hTRD2).

In certain embodiments, an eTF provided herein having a high percent sequence identity to one or more human proteins comprises any one of: (i) a sequence comprising any one of SEQ ID NOs:6-10, 13-16, 57-64, 67-77, 295-299, 313-325, 345-350, 364, 436; (ii) a sequence comprising any one of SEQ ID NOs:22-26, 29-32, 84-93, 385-390, 406-409, 427-435, or 437; (iii) a sequence comprising at least 80%, 85%, 86%, 87%, 88%, 89%, 90%, 91%, 92%, 93%, 94%, 95%, 96%, 97%, 98% or 99% sequence identity to any of the sequences of (i) or (ii); or (iv) a functional fragment or variant of any of the sequences of (i), (ii) or (iii). In exemplary embodiments, such eTFs are capable of upregulating SCN1A or GRN expression by at least at least 2 fold, 5 fold, 10 fold, 15 fold, 20 fold, 25 fold, 30 fold, 40 fold, 50 fold, or greater as compared to a control, or by at least 20%, 30%, 40%, 50%, 60%, 70%, 75%, 80%, 90%, 100%, 125%, 150%, 200%, 250%, 300%, 400%, or 500% or greater as compared to a control. In exemplary embodiments, such eTFs have at least at least 75%, 80%, 85%, 86%, 87%, 88%, 89%, 90%, 91%, 92%, 93%, 94%, 95%, 96%, 97%, 98% or 99% overall sequence identity to one or more human proteins. In certain embodiments, such eTFs exhibits reduced immunogenicity as compared to an eTF having a lower overall percent sequence identity to one or more human proteins. In various embodiments, a reduction in immunogenicity can be measured using an elispot assay, an immunoassay, or an in silico method.

In certain embodiments, an eTF provided herein having a high percent sequence identity to one or more human proteins may additional comprise one or more amino acid sequences or domains in addition to the DBD and TAD domains, such as a nuclear localization signal or a linker, etc. In addition, a polynucleotide encoding an eTF provided herein having a high percent sequence identity to one or more human proteins may additional comprise one or more nucleic acid sequences in addition to the coding sequence for the eTF such as a promoter, enhancer, polyA tail, etc. In such embodiments, one or more of the additional amino acid sequences and/or nucleic acid sequences are preferably human sequences, derived from human sequences, or have at least 75%, 80%, 85%, 86%, 87%, 88%, 89%, 90%, 91%, 92%, 93%, 94%, 95%, 96%, 97%, 98% or 99% sequence identity to a human protein.

Polynucleotides

In another aspect, the application provides polynucleotides encoding any of the eTFs disclosed herein.

In certain embodiments, the application provides a polynucleotide comprising any one of the following: (i) a nucleic acid sequence encoding an eTF comprising any one of SEQ ID NOs: 6-10, 13-16, 57-64, 67-77, 268-282, 305-325, 337-350, 364, 295-299, or 365-366, or a variant or a functional fragment thereof; (ii) a nucleic acid encoding a functional fragment of an eTF having any one of SEQ ID NOs: 6-10, 13-16, 57-64, 67-77, 268-282, 305-325, 337-350, 364, 295-299, or 365-366; or (iii) a nucleic acid encoding an eTF having at least 70%, 75%, 80%, 85%, 86%, 87%, 88%, 89%, 90%, 91%, 92%, 93%, 94%, 95%, 96%, 97%, 98%, 99% or greater sequence identity to an eTF having any one of SEQ ID NOs: 6-10, 13-16, 57-64, 67-77, 112, 268-282, 305-325, 337-350, 364, 295-299, 365-366, or a variant or a functional fragment thereof, wherein the eTF is capable of upregulating SCN1A or GRN.

In certain embodiments, the application provides a polynucleotide comprising any one of the following: (i) a nucleic acid sequence encoding a DBD comprising any one of SEQ ID NOs: 22-26, 29-32, 84-93, 131-135, 165-171, 377-409, or 423-435, or a variant or functional fragment thereof; (ii) a nucleic acid encoding a functional fragment of a DBD having any one of SEQ ID NOs: 22-26, 29-32, 84-93, 131-135, 165-171, 377-409, 423-435; or (iii) a nucleic acid encoding a DBD having at least 70%, 75%, 80%, 85%, 86%, 87%, 88%, 89%, 90%, 91%, 92%, 93%, 94%, 95%, 96%, 97%, 98%, 99% or greater sequence identity to a DBD having any one of SEQ ID NOs: 22-26, 29-32, 84-93, 112, 131-135, 165-171, 377-409, or 432-435, or a variant or functional fragment thereof, wherein the eTF is capable of binding to a target site bound by any one of SEQ ID NOs: 22-26, 29-32, 84-93, 112, 131-135, 165-171, 377-409, 423-435.

In certain embodiments, the application provides a polynucleotide encoding an eTF that upregulates endogenous SCN1A, wherein the polynucleotide comprises any one of the following: (i) a nucleic acid sequence encoding an eTF comprising any one of SEQ ID NOs: 6-9, 13-15, 57-58, 61-62, 67-71, 74-75, 268-282, 295-299, 305-325, or 364-366; (ii) a nucleic acid encoding a functional fragment of an eTF having any one of SEQ ID NOs: 6-9, 13-15, 57-58, 61-62, 67-71, 74-75, 268-282, 295-299, 305-325, or 364-366; or (iii) a nucleic acid encoding an eTF having at least 70%, 75%, 80%, 85%, 86%, 87%, 88%, 89%, 90%, 91%, 92%, 93%, 94%, 95%, 96%, 97%, 98%, 99% or greater sequence identity to an eTF having any one of SEQ ID NOs: 6-9, 13-15, 57-58, 61-62, 67-71, 74-75, 268-282, 295-299, 305-325, or 364-366, wherein the eTF is capable of upregulating SCN1A.

In certain embodiments, the application provides a polynucleotide encoding a DBD that binds to a genomic target site capable of upregulating endogenous SCN1A when bound by an eTF disclosed herein, wherein the polynucleotide comprises any one of the following: (i) a nucleic acid sequence encoding a DBD comprising any one of SEQ ID NOs: 22-25, 29-31, 84-85, 88, 90-92, 131-135, 371-372, 376, 391-409, or 423-435; (ii) a nucleic acid encoding a functional fragment of a DBD having any one of SEQ ID NOs: 22-25, 29-31, 84-85, 88, 90-92, 131-135, 371-372, 376, 391-409, or 423-435; or (iii) a nucleic acid encoding an eTF having at least 70%, 75%, 80%, 85%, 86%, 87%, 88%, 89%, 90%, 91%, 92%, 93%, 94%, 95%, 96%, 97%, 98%, 99% or greater sequence identity to a DBD having any one of SEQ ID NOs: 22-25, 29-31, 84-85, 88, 90-92, 131-135, 371-372, 376, 391-409, or 423-435, wherein the DBD is capable of binding to a target site bound by any one of SEQ ID NOs: 22-25, 29-31, 84-85, 88, 90-92, 131-135, 371-372, 376, 391-409, or 423-435.

In certain embodiments, the application provides a polynucleotide encoding a DBD that binds to a genomic target site capable of upregulating endogenous SCN1A when bound by an eTF disclosed herein, wherein the polynucleotide comprises any one of the following: (i) a nucleic acid sequence encoding a DBD comprising any one of SEQ ID NOs: 135, 371, 372, or 376; (ii) a nucleic acid encoding a functional fragment of a DBD having any one of SEQ ID NOs: 135, 371, 372, or 376; or (iii) a nucleic acid encoding an eTF having at least 70%, 75%, 80%, 85%, 86%, 87%, 88%, 89%, 90%, 91%, 92%, 93%, 94%, 95%, 96%, 97%, 98%, 99% or greater sequence identity to a DBD having any one of SEQ ID NOs: 135, 371, 372, or 376, wherein the DBD is capable of binding to a target site bound by any one of SEQ ID NOs: 22-25, 29-31, 84-85, 88, 90-92, 131-135, 371-372, 376, or 391-409.

In certain embodiments, the application provides a polynucleotide encoding an eTF that upregulates endogenous GRN, wherein the polynucleotide comprises any one of the following: (i) a nucleic acid sequence encoding an eTF comprising any one of SEQ ID NOs: 10, 16, 59-60, 63, 64, 72-73, 76, 77, or 337-350; (ii) a nucleic acid encoding a functional fragment of an eTF having any one of SEQ ID NOs: 10, 16, 59-60, 63, 64, 72-73, 76, 77, or 337-350; or (iii) a nucleic acid encoding an eTF having at least 70%, 75%, 80%, 85%, 86%, 87%, 88%, 89%, 90%, 91%, 92%, 93%, 94%, 95%, 96%, 97%, 98%, 99% or greater sequence identity to an eTF having any one of SEQ ID NOs: 10, 16, 59-60, 63, 64, 72-73, 76, 77, or 337-350, wherein the eTF is capable of upregulating GRN In certain embodiments, the application provides a polynucleotide encoding a DBD that binds to a genomic target site capable of upregulating endogenous GRN when bound by an eTF disclosed herein, wherein the polynucleotide comprises any one of the following: (i) a nucleic acid sequence encoding a DBD comprising any one of SEQ ID NOs: 26, 32, 86-89, 93, 165-171, or 377-390; (ii) a nucleic acid encoding a functional fragment of a DBD having any one of SEQ ID NOs: 26, 32, 86-89, 93, 165-171, or 377-390; or (iii) a nucleic acid encoding an eTF having at least 70%, 75%, 80%, 85%, 86%, 87%, 88%, 89%, 90%, 91%, 92%, 93%, 94%, 95%, 96%, 97%, 98%, 99% or greater sequence identity to a DBD having any one of SEQ ID NOs: 26, 32, 86-89, 93, 165-171, or 377-390, wherein the DBD is capable of binding to a target site bound by any one of SEQ ID NOs: 26, 32, 86-89, 93, 165-171, or 377-390.

In certain embodiments, the application provides a polynucleotide encoding an eTF capable of regulating endogenous SCN1A, wherein the polynucleotide comprises any one of the following: (i) a nucleic acid sequence having any of SEQ ID NOs: 353-363 or 454; (ii) a nucleic acid sequence having any one of SEQ ID NOs: 442-453; (iii) a nucleic acid having a functional fragment of any one of the sequences of (i) or (ii); or (iv) a nucleic acid having at least 70%, 75%, 80%, 85%, 86%, 87%, 88%, 89%, 90%, 91%, 92%, 93%, 94%, 95%, 96%, 97%, 98%, 99% or greater sequence identity to any one of the sequences of (i), (ii) or (iii), wherein the polynucleotide encodes an eTF that is capable of upregulating SCN1A.

In certain embodiments, the application provides a polynucleotide encoding an eTF capable of regulating endogenous SCN1A, wherein the polynucleotide comprises any one of the following: (i) a nucleic acid sequence having SEQ ID NO: 353; (ii) a nucleic acid sequence having SEQ ID NO: 442; (iii) a nucleic acid having a functional fragment of any one of the sequences of (i) or (ii); or (iv) a nucleic acid having at least 70%, 75%, 80%, 85%, 86%, 87%, 88%, 89%, 90%, 91%, 92%, 93%, 94%, 95%, 96%, 97%, 98%, 99% or greater sequence identity to any one of the sequences of (i), (ii) or (iii). In exemplary embodiments, such polynucleotides encode an eTF having SEQ ID NO: 305, or a functional fragment or variant thereof that is capable of upregulating SCN1A.

In certain embodiments, the application provides a polynucleotide encoding an eTF capable of regulating endogenous SCN1A, wherein the polynucleotide comprises any one of the following: (i) a nucleic acid sequence having SEQ ID NO: 354; (ii) a nucleic acid sequence having SEQ ID NO: 443; (iii) a nucleic acid having a functional fragment of any one of the sequences of (i) or (ii); or (iv) a nucleic acid having at least 70%, 75%, 80%, 85%, 86%, 87%, 88%, 89%, 90%, 91%, 92%, 93%, 94%, 95%, 96%, 97%, 98%, 99% or greater sequence identity to any one of the sequences of (i), (ii) or (iii). In exemplary embodiments, such polynucleotides encode an eTF having SEQ ID NO: 306, or a functional fragment or variant thereof that is capable of upregulating SCN1A.

In certain embodiments, the application provides a polynucleotide encoding an eTF capable of regulating endogenous SCN1A, wherein the polynucleotide comprises any one of the following: (i) a nucleic acid sequence having SEQ ID NO: 355 (ii) a nucleic acid sequence having SEQ ID NO: 444; (iii) a nucleic acid having a functional fragment of any one of the sequences of (i) or (ii); or (iv) a nucleic acid having at least 70%, 75%, 80%, 85%, 86%, 87%, 88%, 89%, 90%, 91%, 92%, 93%, 94%, 95%, 96%, 97%, 98%, 99% or greater sequence identity to any one of the sequences of (i), (ii) or (iii). In exemplary embodiments, such polynucleotides encode an eTF having SEQ ID NO: 308, or a functional fragment or variant thereof that is capable of upregulating SCN1A.

In certain embodiments, the application provides a polynucleotide encoding an eTF capable of regulating endogenous SCN1A, wherein the polynucleotide comprises any one of the following: (i) a nucleic acid sequence having SEQ ID NO: 356; (ii) a nucleic acid sequence having SEQ ID NO: 445; (iii) a nucleic acid having a functional fragment of any one of the sequences of (i) or (ii); or (iv) a nucleic acid having at least 70%, 75%, 80%, 85%, 86%, 87%, 88%, 89%, 90%, 91%, 92%, 93%, 94%, 95%, 96%, 97%, 98%, 99% or greater sequence identity to any one of the sequences of (i), (ii) or (iii). In exemplary embodiments, such polynucleotides encode an eTF having SEQ ID NO: 313, or a functional fragment or variant thereof that is capable of upregulating SCN1A.

In certain embodiments, the application provides a polynucleotide encoding an eTF capable of regulating endogenous SCN1A, wherein the polynucleotide comprises any one of the following: (i) a nucleic acid sequence having SEQ ID NO: 357; (ii) a nucleic acid sequence having SEQ ID NO: 451; (iii) a nucleic acid having a functional fragment of any one of the sequences of (i) or (ii); or (iv) a nucleic acid having at least 70%, 75%, 80%, 85%, 86%, 87%, 88%, 89%, 90%, 91%, 92%, 93%, 94%, 95%, 96%, 97%, 98%, 99% or greater sequence identity to any one of the sequences of (i), (ii) or (iii). In exemplary embodiments, such polynucleotides encode an eTF having SEQ ID NO: 314, or a functional fragment or variant thereof that is capable of upregulating SCN1A.

In certain embodiments, the application provides a polynucleotide encoding an eTF capable of regulating endogenous SCN1A, wherein the polynucleotide comprises any one of the following: (i) a nucleic acid sequence having SEQ ID NO: 358; (ii) a nucleic acid sequence having SEQ ID NO: 448; (iii) a nucleic acid having a functional fragment of any one of the sequences of (i) or (ii); or (iv) a nucleic acid having at least 70%, 75%, 80%, 85%, 86%, 87%, 88%, 89%, 90%, 91%, 92%, 93%, 94%, 95%, 96%, 97%, 98%, 99% or greater sequence identity to any one of the sequences of (i), (ii) or (iii). In exemplary embodiments, such polynucleotides encode an eTF having SEQ ID NO: 315, or a functional fragment or variant thereof that is capable of upregulating SCN1A.

In certain embodiments, the application provides a polynucleotide encoding an eTF capable of regulating endogenous SCN1A, wherein the polynucleotide comprises any one of the following: (i) a nucleic acid sequence having SEQ ID NO: 359; (ii) a nucleic acid sequence having SEQ ID NO: 446; (iii) a nucleic acid having a functional fragment of any one of the sequences of (i) or (ii); or (iv) a nucleic acid having at least 70%, 75%, 80%, 85%, 86%, 87%, 88%, 89%, 90%, 91%, 92%, 93%, 94%, 95%, 96%, 97%, 98%, 99% or greater sequence identity to any one of the sequences of (i), (ii) or (iii). In exemplary embodiments, such polynucleotides encode an eTF having SEQ ID NO: 316, or a functional fragment or variant thereof that is capable of upregulating SCN1A.

In certain embodiments, the application provides a polynucleotide encoding an eTF capable of regulating endogenous SCN1A, wherein the polynucleotide comprises any one of the following: (i) a nucleic acid sequence having SEQ ID NO: 360; (ii) a nucleic acid sequence having SEQ ID NO: 447; (iii) a nucleic acid having a functional fragment of any one of the sequences of (i) or (ii); or (iv) a nucleic acid having at least 70%, 75%, 80%, 85%, 86%, 87%, 88%, 89%, 90%, 91%, 92%, 93%, 94%, 95%, 96%, 97%, 98%, 99% or greater sequence identity to any one of the sequences of (i), (ii) or (iii). In exemplary embodiments, such polynucleotides encode an eTF having SEQ ID NO: 317, or a functional fragment or variant thereof that is capable of upregulating SCN1A.

In certain embodiments, the application provides a polynucleotide encoding an eTF capable of regulating endogenous SCN1A, wherein the polynucleotide comprises any one of the following: (i) a nucleic acid sequence having SEQ ID NO: 361; (ii) a nucleic acid sequence having SEQ ID NO: 450; (iii) a nucleic acid having a functional fragment of any one of the sequences of (i) or (ii); or (iv) a nucleic acid having at least 70%, 75%, 80%, 85%, 86%, 87%, 88%, 89%, 90%, 91%, 92%, 93%, 94%, 95%, 96%, 97%, 98%, 99% or greater sequence identity to any one of the sequences of (i), (ii) or (iii). In exemplary embodiments, such polynucleotides encode an eTF having SEQ ID NO: 318, or a functional fragment or variant thereof that is capable of upregulating SCN1A.

In certain embodiments, the application provides a polynucleotide encoding an eTF capable of regulating endogenous SCN1A, wherein the polynucleotide comprises any one of the following: (i) a nucleic acid sequence having SEQ ID NO: 362; (ii) a nucleic acid sequence having SEQ ID NO: 449; (iii) a nucleic acid having a functional fragment of any one of the sequences of (i) or (ii); or (iv) a nucleic acid having at least 70%, 75%, 80%, 85%, 86%, 87%, 88%, 89%, 90%, 91%, 92%, 93%, 94%, 95%, 96%, 97%, 98%, 99% or greater sequence identity to any one of the sequences of (i), (ii) or (iii). In exemplary embodiments, such polynucleotides encode an eTF having SEQ ID NO: 319, or a functional fragment or variant thereof that is capable of upregulating SCN1A.

In certain embodiments, the application provides a polynucleotide encoding an eTF capable of regulating endogenous SCN1A, wherein the polynucleotide comprises any one of the following: (i) a nucleic acid sequence having SEQ ID NO: 454; (ii) a nucleic acid sequence having SEQ ID NO: 452; (iii) a nucleic acid having a functional fragment of any one of the sequences of (i) or (ii); or (iv) a nucleic acid having at least 70%, 75%, 80%, 85%, 86%, 87%, 88%, 89%, 90%, 91%, 92%, 93%, 94%, 95%, 96%, 97%, 98%, 99% or greater sequence identity to any one of the sequences of (i), (ii) or (iii). In exemplary embodiments, such polynucleotides encode an eTF having SEQ ID NO: 440, or a functional fragment or variant thereof that is capable of upregulating SCN1A.

In certain embodiments, the application provides a polynucleotide encoding an eTF capable of regulating endogenous SCN1A, wherein the polynucleotide comprises any one of the following: (i) a nucleic acid sequence having SEQ ID NO: 363; (ii) a nucleic acid sequence having SEQ ID NO: 453; (iii) a nucleic acid having a functional fragment of any one of the sequences of (i) or (ii); or (iv) a nucleic acid having at least 70%, 75%, 80%, 85%, 86%, 87%, 88%, 89%, 90%, 91%, 92%, 93%, 94%, 95%, 96%, 97%, 98%, 99% or greater sequence identity to any one of the sequences of (i), (ii) or (iii). In exemplary embodiments, such polynucleotides encode an eTF having SEQ ID NO: 325, or a functional fragment or variant thereof that is capable of upregulating SCN1A Expression Cassettes In another aspect, the application provides expression cassettes comprising a polynucleotide encoding an eTF as provided herein and one or more regulatory elements.

In certain embodiments, a polynucleotide encoding an eTF disclosed herein is part of an expression cassette comprising one or more regulatory elements in addition to the sequence encoding the eTF. In exemplary embodiments, a polynucleotide encoding an eTF disclosed herein is part of an expression cassette comprising a promoter situated upstream of the sequence encoding the eTF so as to be capable of driving expression of the eTF in a cell.

In certain embodiments, an expression cassette disclosed herein comprises a polynucleotide encoding an eTF and a constitutive promoter situated upstream of the sequence encoding the eTF so as to be capable of driving expression of the eTF in a cell. Examples of constitutive promoters include, a GAD2 promoter, a human synapsin promoter, CBA promoter, a CMV promoter, a minCMV promoter, a TATA box, a super core promoter, or an EF1α promoter, or a combination thereof.

In certain embodiments, an expression cassette disclosed herein comprises a polynucleotide encoding an eTF and a short promoter capable of driving expression of the eTF in a cell. In certain embodiments, a short promoter suitable for use in accordance with the nucleic acid molecules described herein comprises less than 500 bp, 450 bp, 400 bp, 350 bp, 300 bp, 250 bp, 225 bp, 200 bp, 175 bp, 150 bp, 145 bp, 140 bp, 135 bp, 130 bp, 125 bp, 120 bp, 115 bp, 110 bp, 105 bp, 100 bp, 95 bp, 90 bp, 85 bp, 80 bp or 75 bp, or from about 80-300 bp, 80-275 bp, 80-250 bp, 80-200 bp, 80-150 bp, 80-125 bp, 80-120 bp, 80-115 bp, 80-110 bp, 80-105 bp, 80-100 bp, 85-300 bp, 85-275 bp, 85-250 bp, 85-200 bp, 85-150 bp, 85-125 bp, 85-120 bp, 85-115 bp, 85-110 bp, 85-105 bp, 85-100 bp, 90-300 bp, 90-275 bp, 90-250 bp, 90-200 bp, 90-150 bp, 90-125 bp, 90-120 bp, 90-115 bp, 90-110 bp, 90-105 bp, 90-100 bp, 95-300 bp, 95-275 bp, 95-250 bp, 95-200 bp, 95-150 bp, 95-125 bp, 95-120 bp, 95-115 bp, 95-110 bp, 95-105 bp, 95-100 bp, 100-300 bp, 100-275 bp, 100-250 bp, 100-200 bp, 100-150 bp, 100-125 bp, 100-120 bp, 100-115 bp, 100-110 bp, or 100-105 bp. In exemplary embodiments, a short promoter suitable for use in accordance with the expression cassettes described herein comprises from about 100-120 bp, about 117 bp, or about 100 bp.

In certain embodiments, an expression cassette disclosed herein comprises a short promoter comprising or consisting of any one of (i) SEQ ID NO: 178; (ii) a variant or functional fragment thereof; or (iii) a nucleic acid sequence having at least 80%, 81%, 82%, 83%, 84%, 85%, 86%, 87%, 88%, 89%, 90%, 91%, 92%, 93%, 94%, 95%, 96%, 97%, 98%, or 99% sequence identity to any one of (i) or (ii) operably linked to a polynucleotide encoding any one of the eTFs disclosed herein. Other examples of short promoter sequence may be found in PCT Publication No. WO 2018/213786.

In certain embodiments, an expression cassette disclosed herein comprises a polynucleotide encoding an eTF and a cell type selective promoter situated upstream of the sequence encoding the eTF so as to be capable of driving expression of the eTF selectively in a cell of interest. In certain embodiments, a cell type selective promoter may be selective for (e.g., selectively drive expression in) any cell type of interest, such as, for example, a heart cell, liver cell, muscle cell, bone cell, neuron, or sub populations thereof. In an exemplary embodiment, an expression cassette disclosed herein comprises a polynucleotide encoding an eTF and a PV selective regulatory element (e.g., a promoter, enhancer and/or promoter and enhancer) situated upstream of the sequence encoding the eTF so as to be capable of driving expression of the eTF selectively in a PV cell. A PV selective regulatory element refers to a regulatory element that specifically modulates gene expression in a PV neuron. In certain embodiments, PV selective regulatory elements enhance expression in a PV neuron relative to one or more other CNS cell types. In certain embodiments, a PV selective regulatory element suppresses transcription and/or translation processes in off target cell-types.

In certain embodiments, a PV selective regulatory element provided herein results in selective gene expression in a PV cell as compared to off target cell types. In some cases, off target cell types include, but are not limited to, excitatory neurons, non-PV CNS cell-types, and non-neuronal CNS cell types. In certain embodiments, PV selective regulatory elements result in selective gene expression in PV neurons over at least one, two, three, four, five, or more non-PV CNS cell types. In some instances, a non-PV CNS cell is an excitatory neuron, a dopaminergic neuron, an astrocyte, a microglia, a motor neuron, a vascular cell, or a non-GABAergic neuron (e.g., a cell that does not express one or more of GAD2, GAD1, NKX2.1, DLX1, DLX5, SST and VIP), a non-PV neuron (e.g., a GABAergic neuron that does not express parvalbumin), or other CNS cells (e.g., CNS cell types that have never expressed any of PV, GAD2, GAD1, NKX2.1, DLX1, DLX5, SST and VIP). In some cases, a PV selective regulatory element provided herein result in increased selectivity in gene expression in PV neurons as compared to non-PV GABAergic cells. In some cases, cell types are distinguished by having a different cell marker, morphology, phenotype, genotype, function, and/or any other means for classifying cell types.

Selectivity of expression driven by a PV selective regulatory element can be measured in a number of ways. In one embodiment, selectivity of gene expression in a PV cell over non-PV cells can be measured by comparing the number of PV cells that express a detectable level of a transcript from a gene that is operably linked to a PV selective regulatory element to the total number of cells that express the gene (e.g., the ratio of PV vs. total cells (PV+ non-PV cells) expressing the gene). For example, selectivity for PV neurons can be determined using an immunohistochemistry based colocalization assay using a gene encoding a fluorescent protein (e.g., eGFP) operably linked to a PV selective regulatory element to measure gene expression and an antibody that identifies PV cells (e.g., an anti-PV antibody that interacts specifically with PV neurons) linked to a second fluorescence label (e.g., red fluorescent protein). Selectivity of expression in PV cells can be calculated by dividing the number of cells that express both PV and eGFP (e.g., PV cells) by the total number of cells that express eGFP (e.g., PV cells and non-PV cells), and multiplying by 100 to convert into a percentage. The higher the percentage of PV cells that express the transgene, the more selective the regulatory element is for the PV cells. In certain embodiments, a PV selective regulatory element provided herein can be highly selective for expression in PV cells. For example, a PV selective regulatory element provided herein can exhibit about 50%, 55%, 60%, 65%, 70%, 75%, 80%, 85%, 90%, 91%, 92%, 93%, 94%, 95%, 96%, 97%, 98%, 99%, or greater than about 99% selectivity for PV neurons (e.g., PV neurons/total cells x 100).

In some cases, a PV selective regulatory element provided herein is short. In some cases, the size of the PV selective regulatory element is compatible with the cloning capacity of a vector, e.g., a viral vector or rAAV, such that the combined size of a transgene and one or more PV selective regulatory elements does not exceed the cloning capacity of a vector. In some cases, a PV selective regulatory element has a length of up to about 2050 bp, 2000 bp, 1900 bp, 1800 bp, 1700 bp, 1600 bp, 1500 bp, 1400 bp, 1300 bp, 1200 bp, 1100 bp, 1000 bp, 900 bp, 800 bp, 700 bp, 600 bp, 500 bp, 400 bp, 300 bp, 200 bp, or 100 bp. In some cases, a PV selective regulatory element is between about 500-600 bp, 500-700 bp, 500-800 bp, 500-900 bp, 500-1000 bp, or 500-1500 bp.

In certain embodiments, a PV selective regulatory element provided herein comprises or consists of any one of (i) SEQ ID NOs: 183-185 and 417; (ii) a variant, functional fragment, or a combination thereof; or (iii) a nucleic acid sequence having at least 80%, 81%, 82%, 83%, 84%, 85%, 86%, 87%, 88%, 89%, 90%, 91%, 92%, 93%, 94%, 95%, 96%, 97%, 98%, or 99% sequence identity to any one of (i) or (ii). In some cases, a regulatory element comprises any one of SEQ ID NOs: 183-185 and 417. Other examples of PV selective regulatory elements may be found in PCT Publication No. WO 2018/187363.

In exemplary embodiments, the application provides expression cassettes comprising a nucleic acid sequence encoding an SCN1A eTF under the control of a PV selective regulatory element. In certain embodiments, the application provides expression cassettes comprising a nucleic acid sequence encoding an SCN1A eTF comprising a DBD having any one of the following sequences: SEQ ID NOs: 135, 371-372, or 376 under the control of a PV selective regulatory element having any one of SEQ ID NOs: 183-185 or 417. In certain embodiments, the application provides expression cassettes comprising a nucleic acid sequence encoding an SCN1A eTF comprising any one of the following sequences: SEQ ID NOs: 6-9, 13-15, 57-58, 61-62, 67-71, 74-75, 268-282, 295-299, 305-325, or 364-366 under the control of a PV selective regulatory element having any one of SEQ ID NOs: 183-185 or 417. In certain embodiments, the application provides expression cassettes comprising a nucleic acid sequence comprising any one of the following sequences: SEQ ID NOs: 353-363 under the control of a PV selective regulatory element having any one of SEQ ID NOs: 183-185 or 417. In certain embodiments, the application provides expression cassettes comprising a nucleic acid sequence encoding an SCN1A eTF comprising a DBD having any one of the following sequences: SEQ ID NOs: 135, 371, 372, or 376 under the control of a PV selective regulatory element having any one of SEQ ID NOs: 183 or 185. In certain embodiments, the application provides expression cassettes comprising a nucleic acid sequence encoding an SCN1A eTF comprising any one of the following sequences: SEQ ID NOs: 6-9, 13-15, 57-58, 61-62, 67-71, 74-75, 268-282, 295-299, 305-325, or 364-366 under the control of a PV selective regulatory element having any one of SEQ ID NOs: 183 or 185. In certain embodiments, the application provides expression cassettes comprising a nucleic acid sequence comprising any one of the following sequences: SEQ ID NOs: 353-363 under the control of a PV selective regulatory element having any one of SEQ ID NOs: 183 or 185.

In certain embodiments, the application provides expression cassettes comprising a nucleic acid sequence encoding a GRN eTF under the control of a cell type selective regulatory element. In certain embodiments, the cell type selective regulatory element may drive expression of the eTF that upregulates GRN at a higher level in cells selected from the group consisting of: central nervous system cells, frontal cortex cells, glial cells, microglial cells, Purkinje cells, pyramidal cells (e.g., Betz cells), motor neurons, cerebral cortical neurons, and striatum cells as compared to other cell types (e.g., non-CNS cells).

In certain embodiments, an expression cassette provided herein may comprise one more additional regulatory elements in an addition to a promoter, such as, for example, sequences associated with transcription initiation or termination, enhancer sequences, and efficient RNA processing signals. Exemplary regulatory elements include, for example, an intron, an enhancer, UTR, stability element, WPRE sequence, a Kozak consensus sequence, posttranslational response element, a microRNA binding site, or a polyadenylation (polyA) sequence, or a combination thereof. Regulatory elements can function to modulate gene expression at the transcriptional phase, post-transcriptional phase, or at the translational phase of gene expression. At the RNA level, regulation can occur at the level of translation (e.g., stability elements that stabilize mRNA for translation), RNA cleavage, RNA splicing, and/or transcriptional termination. In various embodiments, regulatory elements can recruit transcription factors to a coding region that increase gene expression selectivity in a cell type of interest, increases the rate at which RNA transcripts are produced, increase the stability of RNA produced, and/or increase the rate of protein synthesis from RNA transcripts.

In certain embodiments, the expression cassettes described herein further comprise a polyA sequence. Suitable polyA sequences include, for example, an artificial polyA that is about 75 bp in length (PA75) (see e.g., WO 2018/126116), the bovine growth hormone polyA, SV40 early polyA signal, SV40 late polyA signal, rabbit beta globin polyA, HSV thymidine kinase polyA, protamine gene polyA, adenovirus 5 EIb polyA, growth hormone polyA, or a PBGD polyA. In exemplary embodiments, a polyA sequence suitable for use in the expression cassettes provided herein is an hGH polyA (SEQ ID NO: 327) or a synthetic polyA (SEQ ID NO: 326). Typically, the polyA sequence is positioned downstream of the polynucleotide encoding the eTF in the expression cassettes described herein.

In certain embodiments, the expression cassettes provided herein further comprise one or more nucleic acid sequences encoding one or more nuclear localization signals (NLS). Any NLS peptide that facilitates import of the protein to which is attached into the cell nucleus may be used. Examples of NLS include, for example, the SV40 large T-antigen NLS, the nucleoplasmin NLS, EGL-13 NLS, c-Myc NLS and TUS-protein NLS. See e.g., C. Dingwall et al., J. Cell Biol. 107: 841-9 (1988); J. P. Makkerh et al., Curr Biol. 6: 1025-7 (1996); and M. Ray et al., Bioconjug. Chem. 26: 1004-7 (2015). The NLS may be located anywhere on the eTF protein sequence, but in preferred embodiments is conjugated to the N-terminus of the eTF or a domain of the eTF. In exemplary embodiments, the nucleic acid cassettes provided herein encode an eTF with an NLS fused to the N-terminus of the eTF. In other embodiments, the nucleic acid cassettes provided herein encode an eTF with a first NLS fused to the N-terminus of the eTF and a second NLS located between the DBD and the TAD domain of the eTF.

Expression Vectors

In certain embodiments, the expression cassettes described herein may be incorporated into an expression vector. Expression vectors may be used to deliver an expression cassette to a target cell via transfection or transduction. A vector may be an integrating or non-integrating vector, referring to the ability of the vector to integrate the expression cassette or transgene into the genome of the host cell. Examples of expression vectors include, but are not limited to, (a) non-viral vectors such as nucleic acid vectors including linear oligonucleotides and circular plasmids; artificial chromosomes such as human artificial chromosomes (HACs), yeast artificial chromosomes (YACs), and bacterial artificial chromosomes (BACs or PACs)); episomal vectors; transposons (e.g., PiggyBac); and (b) viral vectors such as retroviral vectors, lentiviral vectors, adenoviral vectors, and adeno-associated viral vectors.

Expression vectors may be linear oligonucleotides or circular plasmids and can be delivered to a cell via various transfection methods, including physical and chemical methods. Physical methods generally refer to methods of delivery employing a physical force to counteract the cell membrane barrier in facilitating intracellular delivery of genetic material. Examples of physical methods include the use of a needle, ballistic DNA, electroporation, sonoporation, photoporation, magnetofection, and hydroporation. Chemical methods generally refer to methods in which chemical carriers deliver a nucleic acid molecule to a cell and may include inorganic particles, lipid-based vectors, polymer-based vectors and peptide-based vectors.

In some embodiments, an expression vector is administered to a target cell using a cationic lipid (e.g., cationic liposome). Various types of lipids have been investigated for gene delivery, such as, for example, a lipid nano emulsion (e.g., which is a dispersion of one immiscible liquid in another stabilized by emulsifying agent) or a solid lipid nanoparticle.

In some embodiments, an expression vector is administered to a target cell using a peptide based delivery vehicle. Peptide based delivery vehicles can have advantages of protecting the genetic material to be delivered, targeting specific cell receptors, disrupting endosomal membranes and delivering genetic material into a nucleus. In some embodiments, an expression vector is administered to a target cell using a polymer based delivery vehicle. Polymer based delivery vehicles may comprise natural proteins, peptides and/or polysaccharides or synthetic polymers. In one embodiment, a polymer based delivery vehicle comprises polyethylenimine (PEI). PEI can condense DNA into positively charged particles which bind to anionic cell surface residues and are brought into the cell via endocytosis. In other embodiments, a polymer based delivery vehicle may comprise poly-L-lysine (PLL), poly (DL-lactic acid) (PLA), poly (DL-lactide-co-glycoside) (PLGA), polyornithine, polyarginine, histones, protamines, dendrimers, chitosans, synthetic amino derivatives of dextran, and/or cationic acrylic polymers. In certain embodiments, polymer based delivery vehicles may comprise a mixture of polymers, such as, for example PEG and PLL.

In certain embodiments, an expression vector may be a viral vector suitable for gene therapy. Preferred characteristics of viral gene therapy vectors or gene delivery vectors may include the ability to be reproducibly and stably propagated and purified to high titers; to mediate targeted delivery (e.g., to deliver the transgene specifically to the tissue or organ of interest without widespread vector dissemination elsewhere); and to mediate gene delivery and transgene expression without inducing harmful side effects.

Several types of viruses, for example the non-pathogenic parvovirus referred to as adeno-associated virus, have been engineered for the purposes of gene therapy by harnessing the viral infection pathway but avoiding the subsequent expression of viral genes that can lead to replication and toxicity. Such viral vectors can be obtained by deleting all, or some, of the coding regions from the viral genome, but leaving intact those sequences (e.g., terminal repeat sequences) that may be necessary for functions such as packaging the vector genome into the virus capsid or the integration of vector nucleic acid (e.g., DNA) into the host chromatin.

In various embodiments, suitable viral vectors include retroviruses (e.g., A-type, B-type, C-type, and D-type viruses), adenovirus, parvovirus (e.g. adeno-associated viruses or AAV), coronavirus, negative strand RNA viruses such as orthomyxovirus (e.g., influenza virus), rhabdovirus (e.g., rabies and vesicular stomatitis virus), paramyxovirus (e.g. measles and Sendai), positive strand RNA viruses such as picornavirus and alphavirus, and double-stranded DNA viruses including adenovirus, herpesvirus (e.g., Herpes Simplex virus types 1 and 2, Epstein-Barr virus, cytomegalovirus), and poxvirus (e.g., vaccinia, fowlpox and canarypox). Examples of retroviruses include avian leukosis-sarcoma virus, human T-lymphotrophic virus type 1 (HTLV-1), bovine leukemia virus (BLV), lentivirus, and spumavirus. Other viruses include Norwalk virus, togavirus, flavivirus, reoviruses, papovavirus, hepadnavirus, and hepatitis virus, for example. Viral vectors may be classified into two groups according to their ability to integrate into the host genome—integrating and non-integrating. Oncoretroviruses and lentiviruses can integrate into host cellular chromatin while adenoviruses, adeno-associated viruses, and herpes viruses predominantly persist in the cell nucleus as extrachromosomal episomes.

In certain embodiments, a suitable viral vector is a retroviral vector. Retroviruses refer to viruses of the family Retroviridae. Examples of retroviruses include oncoretroviruses, such as murine leukemia virus (MLV), and lentiviruses, such as human immunodeficiency virus 1 (HIV-1). Retroviral genomes are single-stranded (ss) RNAs and comprise various genes that may be provided in cis or trans. For example, retroviral genome may contain cis-acting sequences such as two long terminal repeats (LTR), with elements for gene expression, reverse transcription and integration into the host chromosomes. Other components include the packaging signal (psi or ψ), for the specific RNA packaging into newly formed virions and the polypurine tract (PPT), the site of the initiation of the positive strand DNA synthesis during reverse transcription. In addition, the retroviral genome may comprise gag, pol and env genes. The gag gene encodes the structural proteins, the pol gene encodes the enzymes that accompany the ssRNA and carry out reverse transcription of the viral RNA to DNA, and the env gene encodes the viral envelope. Generally, the gag, pol and env are provided in trans for viral replication and packaging.

In certain embodiments, a retroviral vector provided herein may be a lentiviral vector. At least five serogroups or serotypes of lentiviruses are recognized. Viruses of the different serotypes may differentially infect certain cell types and/or hosts. Lentiviruses, for example, include primate retroviruses and non-primate retroviruses. Primate retroviruses include HIV and simian immunodeficiency virus (SIV). Non-primate retroviruses include feline immunodeficiency virus (FIV), bovine immunodeficiency virus (BIV), caprine arthritis-encephalitis virus (CAEV), equine infectious anemia virus (EIAV) and visnavirus. Lentiviruses or lentivectors may be capable of transducing quiescent cells. As with oncoretrovirus vectors, the design of lentivectors may be based on the separation of cis- and trans-acting sequences.

In certain embodiments, the application provides expression vectors that have been designed for delivery by an optimized therapeutic retroviral vector. The retroviral vector can be a lentivirus comprising a left (5') LTR; sequences which aid packaging and/or nuclear import of the virus; a promoter; optionally one or more additional regulatory elements (such as, for example, an enhancer or polyA sequence); optionally a lentiviral reverse response element (RRE); a construct comprising PV selective regulatory element operably linked to a sequence encoding an eTF; optionally an insulator; and a right (3') retroviral LTR.

In exemplary embodiments, a viral vector provided herein is an adeno-associated virus (AAV). AAV is a small, replication-defective, non-enveloped animal virus that infects humans and some other primate species. AAV is not known to cause human disease and induces a mild immune response. AAV vectors can also infect both dividing and quiescent cells without integrating into the host cell genome.

The AAV genome consists of a linear single stranded DNA which is ~4.7 kb in length. The genome consists of two open reading frames (ORF) flanked by an inverted terminal repeat (ITR) sequence that is about 145 bp in length. The ITR consists of a nucleotide sequence at the 5' end (5' ITR) and a nucleotide sequence located at the 3' end (3' ITR) that contain palindromic sequences. The ITRs function in cis by folding over to form T-shaped hairpin structures by complementary base pairing that function as primers during initiation of DNA replication for second strand synthesis. The two open reading frames encode for rep and cap genes that are involved in replication and packaging of the virion. In an exemplary embodiment, an AAV vector provided herein does not contain the rep or cap genes. Such genes may be provided in trans for producing virions as described further below.

In certain embodiments, an AAV vector may include a stuffer nucleic acid. In some embodiments, the stuffer nucleic acid may encode a green fluorescent protein or antibiotic resistance gene such as kanamycin or ampicillin. In certain embodiments, the stuffer nucleic acid may be located outside of the ITR sequences (e.g., as compared to the eTF transgene sequence and regulatory sequences, which are located between the 5' and 3' ITR sequences).

Various serotypes of AAV exist, including AAV1, AAV2, AAV3, AAV4, AAV5, AAV6, AAV7, AAV8, AAV9, AAV10, AAV11, AAV12, and AAV13. These serotypes differ in their tropism, or the types of cells they infect. AAVs may comprise the genome and capsids from multiple serotypes (e.g., pseudotypes). For example, an AAV may comprise the genome of serotype 2 (e.g., ITRs) packaged in the capsid from serotype 5 or serotype 9. Pseudotypes may improve transduction efficiency as well as alter tropism.

In some cases, an AAV serotype that can cross the blood brain barrier or infect cells of the CNS is preferred. In some cases, AAV9 or a variant thereof is used to deliver an expression cassette of this disclosure, comprising a PV selective regulatory elements operably linked to a transgene encoding an eTF that upregulates SCN1A.

Figure 36:
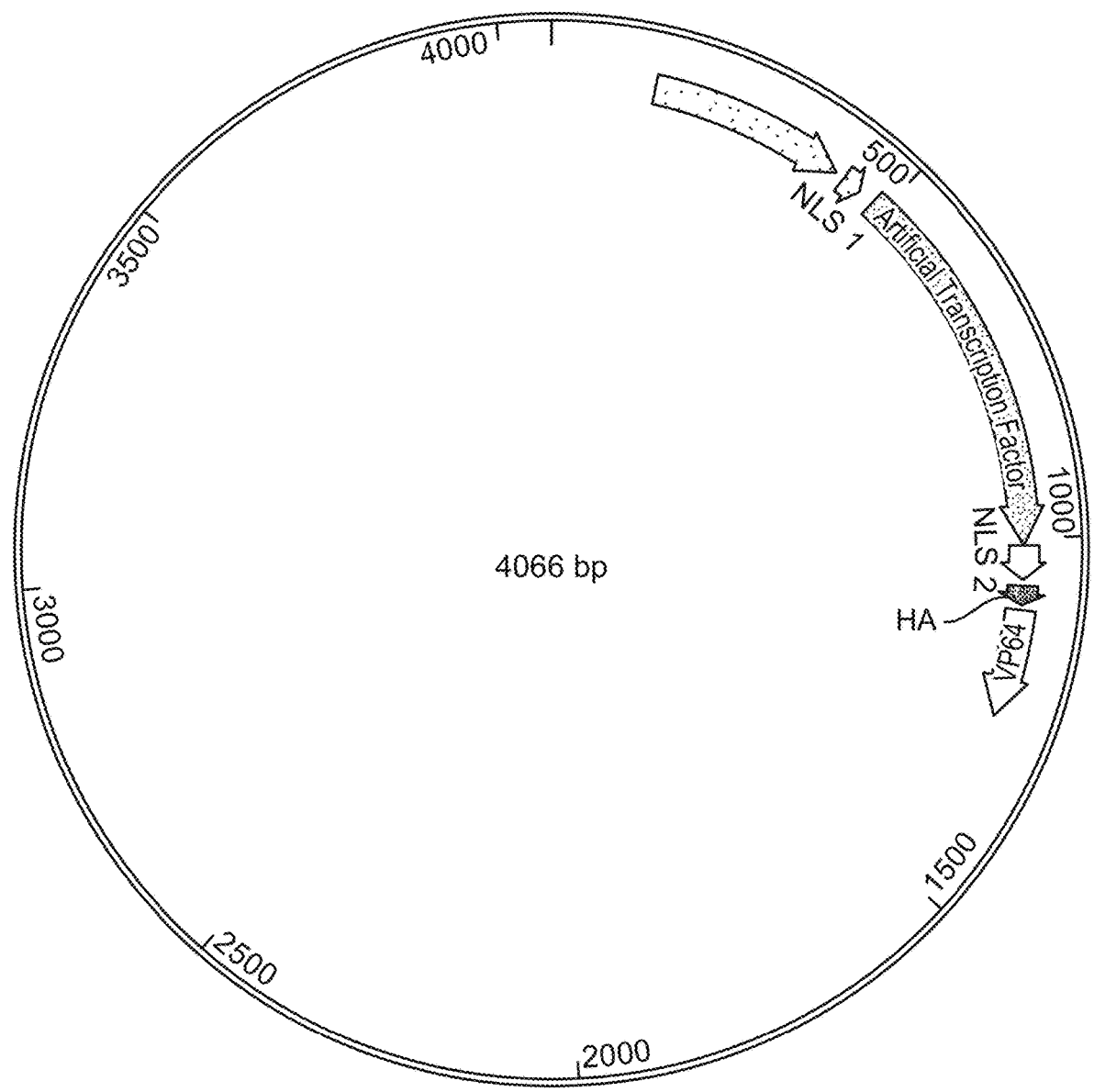
FIG. 36 illustrates a vector that comprises an expression cassette comprising a non-naturally occurring transcriptional modulator, which comprises a DNA binding domain of a transcription factor operably linked to an activation domain of VP64, for increasing expression of the SCN1A gene.
Figure 37:
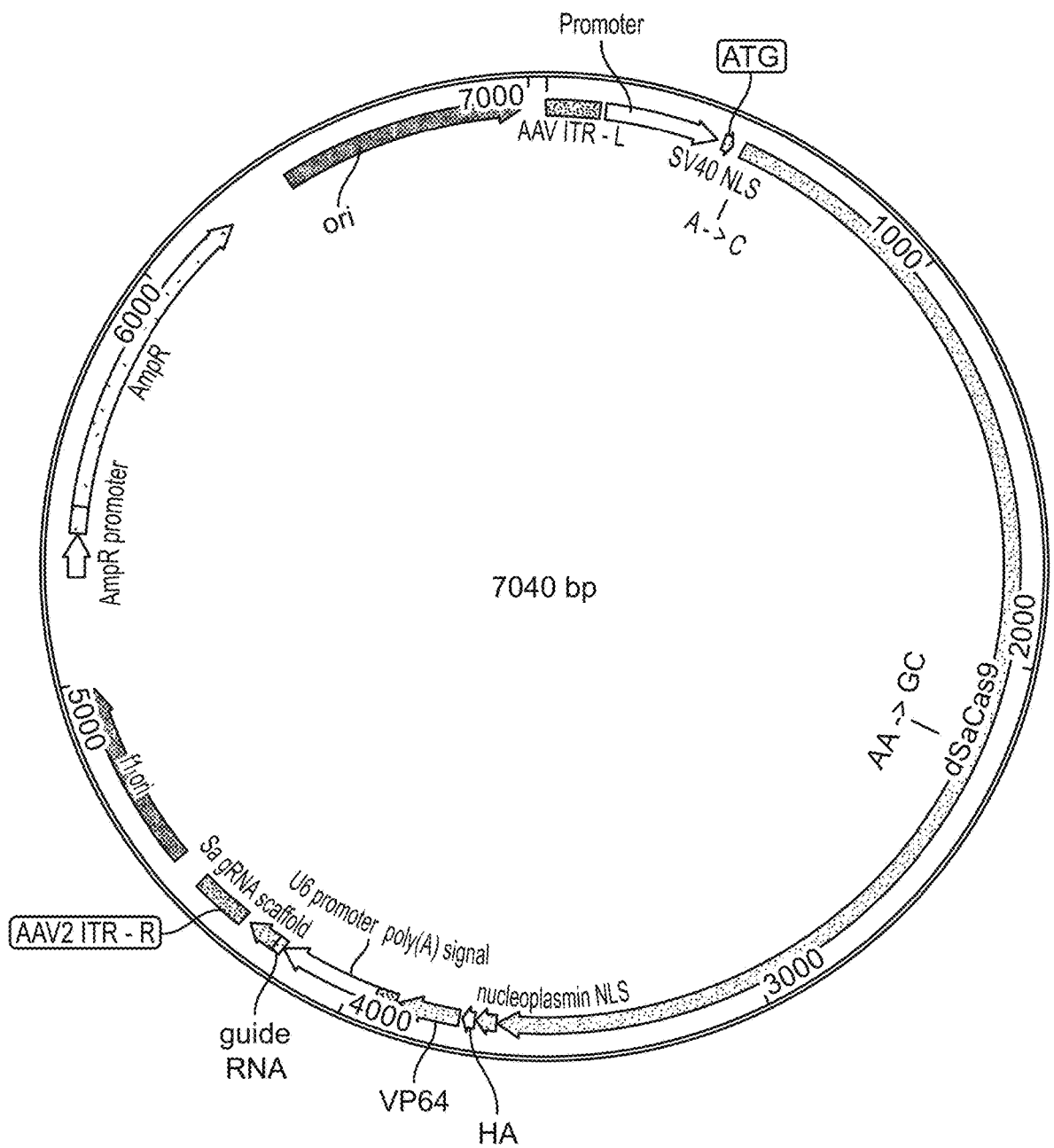
FIG. 37 illustrates an AAV vector comprising an expression cassette which comprises a non-naturally occurring transcriptional modulator, such as a nuclease-inactivated dSaCa9 domain operably linked to a transcriptional activation domain of VP64. Such expression cassette also comprises a guide RNA that is expressed with the dSaCas9 transgene. Other elements illustrated include a nuclear localization signal (NLS), promoter, AAV ITRs, polyA signal, and a selection marker.

In exemplary embodiments, the application provides expression vectors that have been designed for delivery by an AAV. The AAV can be any serotype, for examples, AAV1, AAV2, AAV3, AAV3b, AAV4, AAV5, AAV6, AAV7, AAV8, AAV9, AAV10, AAV11, AAV12, AAV-DJ, or a chimeric, hybrid, or variant AAV. The AAV can also be a self-complementary AAV (scAAV). In certain embodiments, an expression vector designed for delivery by an AAV comprises a 5' ITR and a 3' ITR. In certain embodiments, an expression vector designed for delivery by an AAV comprises a 5' ITR, a promoter, a transgene encoding an eTF, and a 3' ITR. In certain embodiments, an expression vector designed for delivery by an AAV comprises a 5' ITR, an enhancer, a promoter, a transgene encoding an eTF, a polyA sequence, and a 3' ITR. Exemplary AAV expression vectors are illustrated in FIG. 36 and FIG. 37.

Host Cells

In another aspect, the invention relates to a host cell comprising an expression cassette or expression vector encoding an eTF of the invention. Host cells may be a bacterial cell, a yeast cell, an insect cell or a mammalian cell. In an exemplary embodiment, a host cell refers to any cell line that is susceptible to infection by a virus of interest, and amenable to culture in vitro.

In certain embodiments, a host cell provided herein may be used for ex vivo gene therapy purposes. In such embodiments, the cells are transfected with a nucleic acid molecule or expression vector comprising a sequence encoding an eTF of the invention and subsequently transplanted into the patient or subject. Transplanted cells can have an autologous, allogenic or heterologous origin. For clinical use, cell isolation will generally be carried out under Good Manufacturing Practices (GMP) conditions. Before transplantation, cell quality and absence of microbial or other contaminants is typically checked and preconditioning, such as with radiation and/or an immunosuppressive treatment, may be carried out. Furthermore, the host cells may be transplanted together with growth factors to stimulate cell proliferation and/or differentiation.

In certain embodiments, a host cell may be used for ex vivo gene therapy. Preferably, said cells are eukaryotic cells such as mammalian cells, these include, but are not limited to, humans, non-human primates such as apes; chimpanzees; monkeys, and orangutans, domesticated animals, including dogs and cats, as well as livestock such as horses, cattle, pigs, sheep, and goats, or other mammalian species including, without limitation, mice, rats, guinea pigs, rabbits, hamsters, and the like. A person skilled in the art will choose the more appropriate cells according to the patient or subject to be transplanted.

In certain embodiments, a host cell provided herein may be a cell with self-renewal and pluripotency properties, such as stem cells or induced pluripotent stem cells. Stem cells are preferably mesenchymal stem cells. Mesenchymal stem cells (MSCs) are capable of differentiating into at least one of an osteoblast, a chondrocyte, an adipocyte, or a myocyte and may be isolated from any type of tissue. Generally, MSCs will be isolated from bone marrow, adipose tissue, umbilical cord, or peripheral blood. Methods for obtaining thereof are well known to a person skilled in the art. Induced pluripotent stem cells (also known as iPS cells or iPSCs) are a type of pluripotent stem cell that can be generated directly from adult cells. Yamanaka et al. induced iPS cells by transferring the Oct3/4, Sox2, Klf4 and c-Myc genes into mouse and human fibroblasts, and forcing the cells to express the genes (WO 2007/069666). Thomson et al. subsequently produced human iPS cells using Nanog and Lin28 in place of Klf4 and c-Myc (WO 2008/118820).

In an exemplary embodiment, a host cell provided herein is a packaging cell. Said cells can be adherent or suspension cells. The packaging cell, and helper vector or virus or DNA construct(s) provide together in trans all the missing functions which are required for the complete replication and packaging of the viral vector.

Preferably, said packaging cells are eukaryotic cells such as mammalian cells, including simian, human, dog and rodent cells. Examples of human cells are PER.C6 cells (WO01/38362), MRC-5 (ATCC CCL-171), WI-38 (ATCC CCL-75), HEK-293 cells (ATCC CRL-1573), HeLa cells (ATCC CCL2), and fetal rhesus lung cells (ATCC CL-160). Examples of non-human primate cells are Vero cells (ATCC CCL81), COS-1 cells (ATCC CRL-1650) or COS-7 cells (ATCC CRL-1651). Examples of dog cells are MDCK cells (ATCC CCL-34). Examples of rodent cells are hamster cells, such as BHK21-F, HKCC cells, or CHO cells.

As an alternative to mammalian sources, cell lines for use in the invention may be derived from avian sources such as chicken, duck, goose, quail or pheasant. Examples of avian cell lines include avian embryonic stem cells (WO01/85938 and WO03/076601), immortalized duck retina cells (WO2005/042728), and avian embryonic stem cell derived cells, including chicken cells (WO2006/108846) or duck cells, such as EB66 cell line (WO2008/129058 & WO2008/142124).

In another embodiment, said host cell are insect cells, such as SF9 cells (ATCC CRL-1711), Sf21 cells (IPLB-Sf21), MG1 cells (BTI-TN-MG1) or High Five™ cells (BTI-TN-5B1-4).

In certain embodiments, the host cells provided herein comprising the recombinant AAV vector/genome of the invention (e.g., comprising a sequence encoding an eTF) may further comprise one or more additional nucleic acid constructs, such as, for example (i) a nucleic acid construct (e.g., an AAV helper plasmid) that encodes rep and cap genes, but does not carry ITR sequences; and/or (ii) a nucleic acid construct (e.g., a plasmid) providing the adenoviral functions necessary for AAV replication. In an exemplary embodiment, a host cell provided herein comprises: i) an expression vector comprising a sequence encoding an eTF of the invention (i.e., the recombinant AAV genome); ii) a nucleic acid construct encoding AAV rep and cap genes which does not carry the ITR sequences; and iii) a nucleic acid construct comprising adenoviral helper genes (as described further below).

In certain embodiments, the rep, cap, and adenoviral helper genes can be combined on a single plasmid (Blouin V et al. J Gene Med. 2004; 6 (suppl): S223-S228; Grimm D. et al. Hum. Gene Ther. 2003; 7: 839-850). Thus, in another exemplary embodiment, a host cell provided herein comprises: i) an expression vector comprising a sequence encoding an eTF of the invention (i.e., the recombinant AAV genome); and ii) a plasmid encoding AAV rep and cap genes which does not carry the ITR sequences and further comprising adenoviral helper genes.

In another embodiment, a host cell provided herein comprises: a) an expression vector comprising a sequence encoding an eTF of the invention (i.e., the recombinant AAV genome); b) a plasmid encoding AAV rep and cap genes which does not carry the ITR sequences; and c) a plasmid comprising adenoviral helper genes E2a, E4, and VA RNAs; wherein co-transfection is performed in cells, preferably mammalian cells, that constitutively express and trans-complement the adenoviral E1 gene, like HEK-293 cells (ATCC CRL-1573).

In certain embodiments, a host cell suitable for large-scale production of AAV vectors is an insect cells that can be infected with a combination of recombinant baculoviruses (Urabe et al. Hum. Gene Ther. 2002; 13: 1935-1943). For example, SF9 cells may be co-infected with three baculovirus vectors respectively expressing AAV rep, AAV cap and the AAV vector to be packaged. The recombinant baculovirus vectors will provide the viral helper gene functions required for virus replication and/or packaging.

Further guidance for the construction and production of virions for gene therapy according to the invention can be found in: Viral Vectors for Gene Therapy, Methods and Protocols. Series: Methods in Molecular Biology, Vol. 737. Merten and Al-Rubeai (Eds.); 2011 Humana Press (Springer); Gene Therapy. M. Giacca. 2010 Springer-Verlag; Heilbronn R. and Weger S. Viral Vectors for Gene Transfer: Current Status of Gene Therapeutics. In: Drug Delivery, Handbook of Experimental Pharmacology 197; M. Schafer-Korting (Ed.). 2010 Springer-Verlag; pp. 143-170; Adeno-Associated Virus: Methods and Protocols. R. O. Snyder and P. Moulllier (Eds). 2011 Humana Press (Springer); Bunning H. et al. Recent developments in adeno-associated virus technology. J. Gene Med. 2008; 10:717-733; and Adenovirus: Methods and Protocols. M. Chillon and A. Bosch (Eds.); Third. Edition. 2014 Humana Press (Springer).

Virions & Methods of Producing Virions

In certain embodiments, the application provides viral particles comprising a viral vector comprising a sequence encoding an eTF of the invention. The terms "viral particle", and "virion" are used herein interchangeably and relate to an infectious and typically replication-defective virus particle comprising the viral genome (e.g., the viral expression vector) packaged within a capsid and, as the case may be e.g., for retroviruses, a lipidic envelope surrounding the capsid. A "capsid" refers to the structure in which the viral genome is packaged. A capsid consists of several oligomeric structural subunits made of proteins. For example, AAV have an icosahedral capsid formed by the interaction of three capsid proteins: VP1, VP2 and VP3. In one embodiment, a virion provided herein is a recombinant AAV virion or rAAV virion obtained by packaging an AAV vector comprising a PV selective regulatory element operably linked to a sequence encoding eTF as described herein in a protein shell.

In certain embodiments, a recombinant AAV virion provided herein may be prepared by encapsidating an AAV genome derived from a particular AAV serotype in a viral particle formed by natural Cap proteins corresponding to an AAV of the same particular serotype. In other embodiments, an AAV viral particle provided herein comprises a viral vector comprising ITR(s) of a given AAV serotype packaged into proteins from a different serotype. See e.g., Bunning H et al. J Gene Med 2008; 10: 717-733. For example, a viral vector having ITRs from a given AAV serotype may be packaged into: a) a viral particle constituted of capsid proteins derived from a same or different AAV serotype (e.g. AAV2 ITRs and AAV9 capsid proteins; AAV2 ITRs and AAV8 capsid proteins; etc.); b) a mosaic viral particle constituted of a mixture of capsid proteins from different AAV serotypes or mutants (e.g. AAV2 ITRs with AAV1 and AAV9 capsid proteins); c) a chimeric viral particle constituted of capsid proteins that have been truncated by domain swapping between different AAV serotypes or variants (e.g. AAV2 ITRs with AAV8 capsid proteins with AAV9 domains); or d) a targeted viral particle engineered to display selective binding domains, enabling stringent interaction with target cell specific receptors (e.g. AAV5 ITRs with AAV9 capsid proteins genetically truncated by insertion of a peptide ligand; or AAV9 capsid proteins non-genetically modified by coupling of a peptide ligand to the capsid surface).

The skilled person will appreciate that an AAV virion provided herein may comprise capsid proteins of any AAV serotype. In one embodiment, the viral particle comprises capsid proteins from an AAV serotype selected from the group consisting of an AAV1, an AAV2, an AAV5, an AAV8, and an AAV9, which are more suitable for delivery to the CNS (M. Hocquemiller et al., Hum Gene Ther 27(7): 478-496 (2016)). In a particular embodiment, the viral particle comprises an expression cassette of the invention wherein the 5'ITR and 3'ITR sequences of the expression cassette are of an AAV2 serotype and the capsid proteins are of an AAV9 serotype.

Numerous methods are known in the art for production of rAAV virions, including transfection, stable cell line production, and infectious hybrid virus production systems which include adenovirus-AAV hybrids, herpesvirus-AAV hybrids (Conway, J E et al., (1997) J. Virology 71(11):8780-8789) and baculovirus-AAV hybrids. rAAV production cultures for the production of rAAV virus particles all require; 1) suitable host cells, including, for example, human-derived cell lines such as HeLa, A549, or 293 cells, or insect-derived cell lines such as SF-9, in the case of baculovirus production systems; 2) suitable helper virus function, provided by wild-type or mutant adenovirus (such as temperature sensitive adenovirus), herpes virus, baculovirus, or a plasmid construct providing helper functions; 3) AAV rep and cap genes and gene products; 4) a transgene (e.g., a promoter operably linked to a sequence encoding an eTF as described herein) flanked by AAV ITR sequences; and 5) suitable media and media components to support rAAV production.

In various embodiments, the host cells described herein comprise the following three components: (1) a rep gene and a cap gene, (2) genes providing helper functions, and (3) a transgene (e.g., a promoter operably linked to a sequence encoding an eTF described herein flanked by ITRs). The AAV rep gene, AAV cap gene, and genes providing helper functions can be introduced into the cell by incorporating said genes into a vector such as, for example, a plasmid, and introducing said vector into the host cell. The rep, cap and helper function genes can be incorporated into the same plasmid or into different plasmids. In a preferred embodiment, the AAV rep and cap genes are incorporated into one plasmid and the genes providing helper functions are incorporated into another plasmid. The various plasmids for creation of a host cell for virion production (e.g., comprising AAV rep and cap genes, helper functions, or a transgene) can be introduced into the cell by using any suitable method well known in the art. Examples of transfection methods include, but are not limited to, co-precipitation with calcium phosphate, DEAE-dextran, polybrene, electroporation, microinjection, liposome-mediated fusion, lipofection, retrovirus infection and biolistic transfection. In certain embodiments, the plasmids providing the rep and cap genes, the helper functions and the transgene (e.g., a promoter operably linked to a sequence encoding an eTF disclosed herein flanked by ITRs) can be introduced into the cell simultaneously. In another embodiment, the plasmids providing the rep and cap genes and the helper functions can be introduced in the cell before or after the introduction of plasmid comprising the transgene. In an exemplary embodiment, the cells are transfected simultaneously with three plasmids (e.g., a triple transfection method): (1) a plasmid comprising the transgene (e.g., a promoter operably linked to a sequence encoding an eTF disclosed herein flanked by ITRs), (2) a plasmid comprising the AAV rep and cap genes, and (3) a plasmid comprising the genes providing the helper functions. Exemplary host cells may be 293, A549 or HeLa cells.

In other embodiments, one or more of (1) the AAV rep and cap genes, (2) genes providing helper functions, and (3) the transgene, may be carried by the packaging cell, either episomally and/or integrated into the genome of the packaging cell. In one embodiment, host cells may be packaging cells in which the AAV rep and cap genes and helper functions are stably maintained in the host cell and the host cell is transiently transfected with a plasmid containing a transgene (e.g., a promoter operably linked to a sequence encoding an eTF disclosed herein flanked by ITRs). In another embodiment, host cells are packaging cells in which the AAV rep and cap genes are stably maintained in the host cell and the host cell is transiently transfected with a plasmid containing a transgene (e.g., a promoter operably linked to a sequence encoding an eTF disclosed herein flanked by ITRs) and a plasmid containing the helper functions. In another embodiment, host cells may be packaging cells in which the helper functions are stably maintained in the host cell and the host cell is transiently transfected with a plasmid containing a transgene (e.g., a promoter operably linked to a sequence encoding an eTF disclosed herein flanked by ITRs) and a plasmid containing rep and cap genes. In another embodiment, host cells may be producer cell lines that are stably transfected with rep and cap genes, helper functions and the transgene sequence (e.g., a promoter operably linked to a sequence encoding an eTF disclosed herein flanked by ITRs). Exemplary packaging and producer cells may be derived from 293, A549 or HeLa cells.

In another embodiment, the producer cell line is an insect cell line (typically Sf9 cells) that is infected with baculovirus expression vectors that provide Rep and Cap proteins. This system does not require adenovirus helper genes (Ayuso E, et al., Curr. Gene Ther. 2010, 10:423-436).

The term "cap protein", as used herein, refers to a polypeptide having at least one functional activity of a native AAV Cap protein (e.g. VP1, VP2, VP3). Examples of functional activities of cap proteins include the ability to induce formation of a capsid, facilitate accumulation of single-stranded DNA, facilitate AAV DNA packaging into capsids (i.e. encapsidation), bind to cellular receptors, and facilitate entry of the virion into host cells. In principle, any Cap protein can be used in the context of the present invention.

Cap proteins have been reported to have effects on host tropism, cell, tissue, or organ specificity, receptor usage, infection efficiency, and immunogenicity of AAV viruses. Accordingly, an AAV cap for use in an rAAV may be selected taking into consideration, for example, the subject's species (e.g. human or non-human), the subject's immunological state, the subject's suitability for long or short-term treatment, or a particular therapeutic application (e.g. treatment of a particular disease or disorder, or delivery to particular cells, tissues, or organs). In certain embodiments, the cap protein is derived from the AAV of the group consisting of AAV1, AAV2, AAV5, AAV8, and AAV9 serotypes. In an exemplary embodiment, the cap protein is derived from AAV9.

In some embodiments, an AAV Cap for use in the method of the invention can be generated by mutagenesis (i.e. by insertions, deletions, or substitutions) of one of the aforementioned AAV caps or its encoding nucleic acid. In some embodiments, the AAV cap is at least 70%, 75%, 80%, 85%, 90%, 95%, 98%, or 99% or more similar to one or more of the aforementioned AAV caps.

In some embodiments, the AAV cap is chimeric, comprising domains from two, three, four, or more of the aforementioned AAV caps. In some embodiments, the AAV cap is a mosaic of VP1, VP2, and VP3 monomers originating from two or three different AAV or a recombinant AAV. In some embodiments, a rAAV composition comprises more than one of the aforementioned caps.

In some embodiments, an AAV cap for use in a rAAV virion is engineered to contain a heterologous sequence or other modification. For example, a peptide or protein sequence that confers selective targeting or immune evasion may be engineered into a cap protein. Alternatively or in addition, the cap may be chemically modified so that the surface of the rAAV is polyethylene glycolated (i.e., pegylated), which may facilitate immune evasion. The cap protein may also be mutagenized (e.g., to remove its natural receptor binding, or to mask an immunogenic epitope).

The term "rep protein", as used herein, refers to a polypeptide having at least one functional activity of a native AAV rep protein (e.g. rep 40, 52, 68, 78). Examples of functional activities of a rep protein include any activity associated with the physiological function of the protein, including facilitating replication of DNA through recognition, binding and nicking of the AAV origin of DNA replication as well as DNA helicase activity. Additional functions include modulation of transcription from AAV (or other heterologous) promoters and site-specific integration of AAV DNA into a host chromosome. In a particular embodiment, AAV rep genes may be from the serotypes AAV1, AAV2, AAV4, AAV5, AAV6, AAV7, AAV8, AAV9, AAV10 or AAVrh10; more preferably from an AAV serotype selected from the group consisting of AAV1, AAV2, AAV5, AAV8, and AAV9.

In some embodiments, an AAV rep protein for use in the method of the invention can be generated by mutagenesis (i.e. by insertions, deletions, or substitutions) of one of the aforementioned AAV reps or its encoding nucleic acid. In some embodiments, the AAV rep is at least 70%, 75%, 80%, 85%, 90%, 95%, 98%, or 99% or more similar to one or more of the aforementioned AAV reps.

The expressions "helper functions" or "helper genes", as used herein, refer to viral proteins upon which AAV is dependent for replication. The helper functions include those proteins required for AAV replication including, without limitation, those proteins involved in activation of AAV gene transcription, stage specific AAV mRNA splicing, AAV DNA replication, synthesis of cap expression products, and AAV capsid assembly. Viral-based accessory functions can be derived from any of the known helper viruses such as adenovirus, herpesvirus (other than herpes simplex virus type-1), and vaccinia virus. Helper functions include, without limitation, adenovirus E1, E2a, VA, and E4 or herpesvirus UL5, ULB, UL52, and UL29, and herpesvirus polymerase. In a preferred embodiment, the proteins upon which AAV is dependent for replication are derived from adenovirus.

In some embodiments, a viral protein upon which AAV is dependent for replication for use in the method of the invention can be generated by mutagenesis (i.e. by insertions, deletions, or substitutions) of one of the aforementioned viral proteins or its encoding nucleic acid. In some embodiments, the viral protein is at least 70%, 75%, 80%, 85%, 90%, 95%, 98%, or 99% or more similar to one or more of the aforementioned viral proteins.

Methods for assaying the functions of cap proteins, rep proteins and viral proteins upon which AAV is dependent for replication are well known in the art.

Host cells for expressing a transgene of interest (e.g., a promoter operably linked to a sequence encoding an eTF) may be grown under conditions adequate for assembly of the AAV virions. In certain embodiments, host cells are grown for a suitable period of time in order to promote the assembly of the AAV virions and the release of virions into the media. Generally, cells may be grown for about 24 hours, about 36 hours, about 48 hours, about 72 hours, about 4 days, about 5 days, about 6 days, about 7 days, about 8 days, about 9 days, or up to about 10 days. After about 10 days (or sooner, depending on the culture conditions and the particular host cell used), the level of production generally decreases significantly. Generally, time of culture is measured from the point of viral production. For example, in the case of AAV, viral production generally begins upon supplying helper virus function in an appropriate host cell as described herein. Generally, cells are harvested about 48 to about 100, preferably about 48 to about 96, preferably about 72 to about 96, preferably about 68 to about 72 hours after helper virus infection (or after viral production begins).

rAAV production cultures can be grown under a variety of conditions (over a wide temperature range, for varying lengths of time, and the like) suitable to the particular host cell being utilized. rAAV production cultures include attachment-dependent cultures which can be cultured in suitable attachment-dependent vessels such as, for example, roller bottles, hollow fiber filters, microcarriers, and packed-bed or fluidized-bed bioreactors. rAAV vector production cultures may also include suspension-adapted host cells such as HeLa, 293, and SF-9 cells which can be cultured in a variety of ways including, for example, spinner flasks, stirred tank bioreactors, and disposable systems such as the Wave bag system.

Suitable media known in the art may be used for the production of rAAV virions. These media include, without limitation, media produced by Hyclone Laboratories and JRH including Modified Eagle Medium (MEM), Dulbecco's Modified Eagle Medium (DMEM), each of which is incorporated herein by reference in its entirety. In certain embodiments, rAAV production culture media may be supplemented with serum or serum-derived recombinant proteins at a level of 0.5%-20% (v/v or w/v). Alternatively, rAAV vectors may be produced in serum-free conditions which may also be referred to as media with no animal-derived products.

After culturing the host cells to allow AAV virion production, the resulting virions may be then be harvested and purified. In certain embodiments, the AAV virions can be obtained from (1) the host cells of the production culture by lysis of the host cells, and/or (2) the culture medium of said cells after a period of time post-transfection, preferably 72 hours. The rAAV virions may be harvested from the spent media from the production culture, provided the cells are cultured under conditions that cause release of rAAV virions into the media from intact cells (see e.g., U.S. Pat. No. 6,566,118). Suitable methods of lysing cells are also known in the art and include for example multiple freeze/thaw cycles, sonication, microfluidization, and treatment with chemicals, such as detergents and/or proteases.

After harvesting, the rAAV virions may be purified. The term "purified" as used herein includes a preparation of rAAV virions devoid of at least some of the other components that may also be present where the rAAV virions naturally occur or are initially prepared from. Thus, for example, purified rAAV virions may be prepared using an isolation technique to enrich it from a source mixture, such as a culture lysate or production culture supernatant. Enrichment can be measured in a variety of ways, such as, for example, by the proportion of DNase-resistant particles (DRPs) or genome copies (gc) present in a solution, or by infectivity, or it can be measured in relation to a second, potentially interfering substance present in the source mixture, such as contaminants, including production culture contaminants or in-process contaminants, including helper virus, media components, and the like.

In certain embodiments, the rAAV production culture harvest may be clarified to remove host cell debris. In some embodiments, the production culture harvest may be clarified using a variety of standard techniques, such as, centrifugation or filtration through a filter of 0.2 μm or greater pore size (e.g., a cellulose acetate filter or a series of depth filters).

In certain embodiments, the rAAV production culture harvest is further treated with Benzonase™ to digest any high molecular weight DNA present in the production culture. In some embodiments, the Benzonase™ digestion is performed under standard conditions, for example, a final concentration of 1-2.5 units/ml of Benzonase™ at a temperature ranging from ambient to 37° C. for a period of 30 minutes to several hours.

In certain embodiments, the rAAV virions may be isolated or purified using one or more of the following purification steps: equilibrium centrifugation; flow-through anionic exchange filtration; tangential flow filtration (TFF) for concentrating the rAAV particles; rAAV capture by apatite chromatography; heat inactivation of helper virus; rAAV capture by hydrophobic interaction chromatography; buffer exchange by size exclusion chromatography (SEC); nano-filtration; and rAAV capture by anionic exchange chromatography, cationic exchange chromatography, or affinity chromatography. These steps may be used alone, in various combinations, or in different orders. Methods to purify rAAV particles are found, for example, in Xiao et al., (1998) Journal of Virology 72:2224-2232; U.S. Pat. Nos. 6,989,264 and 8,137,948; and WO 2010/148143.

In certain embodiments, purified AAV virions can be dialyzed against PBS, filtered and stored at −80° C. Titers of viral genomes can be determined by quantitative PCR using linearized plasmid DNA as standard curve (see e.g., Lock M, et al., Hum. Gene Ther. 2010; 21:1273-1285).

Pharmaceutical Compositions

In certain embodiments, the application provides compositions comprising a sequence encoding an eTF and a pharmaceutically acceptable carrier. In other embodiments, the application provides virions comprising a sequence encoding an eTF and a pharmaceutically acceptable carrier. In exemplary embodiments, such compositions are suitable for gene therapy applications. Pharmaceutical compositions are preferably sterile and stable under conditions of manufacture and storage. Sterile solutions may be accomplished, for example, by filtration through sterile filtration membranes.

Acceptable carriers and excipients in the pharmaceutical compositions are preferably nontoxic to recipients at the dosages and concentrations employed. Acceptable carriers and excipients may include buffers such as phosphate, citrate, HEPES, and TAE, antioxidants such as ascorbic acid and methionine, preservatives such as hexamethonium chloride, octadecyldimethylbenzyl ammonium chloride, resorcinol, and benzalkonium chloride, proteins such as human serum albumin, gelatin, dextran, and immunoglobulins, hydrophilic polymers such as polyvinylpyrrolidone, amino acids such as glycine, glutamine, histidine, and lysine, and carbohydrates such as glucose, mannose, sucrose, and sorbitol. Pharmaceutical compositions of the disclosure can be administered parenterally in the form of an injectable formulation. Pharmaceutical compositions for injection can be formulated using a sterile solution or any pharmaceutically acceptable liquid as a vehicle. Pharmaceutically acceptable vehicles include, but are not limited to, sterile water and physiological saline.

The pharmaceutical compositions of the disclosure may be prepared in microcapsules, such as hydroxymethylcellulose or gelatin-microcapsules and polymethylmethacrylate microcapsules. The pharmaceutical compositions of the disclosure may also be prepared in other drug delivery systems such as liposomes, albumin microspheres, microemulsions, nano-particles, and nanocapsules. The pharmaceutical composition for gene therapy can be in an acceptable diluent, or can comprise a slow release matrix in which the gene delivery vehicle is imbedded.

Pharmaceutical compositions provided herein may be formulated for parenteral administration, subcutaneous administration, intravenous administration, intramuscular administration, intra-arterial administration, intraparenchymal administration, intrathecal administration, intra-cisterna magna administration, intracerebroventricular administration, or intraperitoneal administration. The pharmaceutical composition may also be formulated for, or administered via, nasal, spray, oral, aerosol, rectal, or vaginal administration. In one embodiment, a pharmaceutical composition provided herein is administered to the CNS or cerebral spinal fluid (CSF), i.e. by intraparenchymal injection, intrathecal injection, intra-cisterna magna injection, or intracerebroventricular injection. The tissue target may be specific, for example the CNS, or it may be a combination of several tissues, for example the muscle and CNS tissues. Exemplary tissue or other targets may include liver, skeletal muscle, heart muscle, adipose deposits, kidney, lung, vascular endothelium, epithelial, hematopoietic cells, CNS and/or CSF. In a preferred embodiment, a pharmaceutical composition provided herein comprising an ETF that upregulates SCN1A or GRN is administered to the CNS or CSF injection, i.e. by intraparenchymal injection, intrathecal injection, intra-cisterna magna injection, or intracerebroventricular injection. One or more of these methods may be used to administer a pharmaceutical composition of the disclosure.

In certain embodiments, a pharmaceutical composition provided herein comprises an "effective amount" or a "therapeutically effective amount." As used herein, such amounts refer to an amount effective, at dosages and for periods of time necessary to achieve the desired therapeutic result, such as increasing the level of SCN1A expression and/or decreasing the frequency and/or duration of seizures or increasing the level of GRN expression and/or treating a disease or disorder associated with GRN such as FTD.

The dosage of the pharmaceutical compositions of the disclosure depends on factors including the route of administration, the disease to be treated, and physical characteristics (e.g., age, weight, general health) of the subject. Dosage may be adjusted to provide the optimum therapeutic response. Typically, a dosage may be an amount that effectively treats the disease without inducing significant toxicity. In one embodiment, an AAV vector provided herein can be administered to the patient for the treatment of an SCN1A deficiency (including for example, Dravet syndrome) or for treatment of a GRN deficiency (including for example, FTD) in an amount or dose within a range of $5\times10^{11}$ to $1\times10^{14}$ gc/kg (genome copies per kilogram of patient body weight (gc/kg)). In a more particular embodiment, the AAV vector is administered in an amount comprised within a range of about $5\times10^{11}$ gc/kg to about $3\times10^{13}$ gc/kg, or about $1\times10^{12}$ to about $1\times10^{14}$ gc/kg, or about $1\times10^{12}$ to about $1\times10^{13}$ gc/kg, or about $5\times10^{11}$ gc/kg, $1\times10^{12}$ gc/kg, $1.5\times10^{12}$ gc/kg, $2.0\times10^{12}$ gc/kg, $2.5\times10^{12}$ gc/kg, $3\times10^{12}$ gc/kg, $3.5\times10^{12}$ gc/kg, $4\times10^{12}$ gc/kg, $4.5\times10^{12}$ gc/kg, $5\times10^{12}$ gc/kg, $5.5\times10^{12}$ gc/kg, $6\times10^{12}$ gc/kg, $6.5\times10^{12}$ gc/kg, $7\times10^{12}$ gc/kg, $7.5\times10^{12}$ gc/kg, $8\times10^{12}$ gc/kg, $8.5\times10^{12}$ gc/kg, $9\times10^{12}$ gc/kg or $9.5\times10^{12}$ gc/kg. The gc/kg may be determined, for example, by qPCR or digital droplet PCR (ddPCR) (see e.g., M. Lock et al, Hum Gene Ther Methods. 2014 April; 25(2): 115-25). In another embodiment, an AAV vector provided herein can be administered to the patient for the treatment of an SCN1A deficiency (including for example, Dravet syndrome) in an amount or dose within a range of $1\times10^{9}$ to $1\times10^{11}$ iu/kg (infective units of the vector (iu)/subject's or patient's body weight (kg)). In certain embodiments, the pharmaceutical composition may be formed in a unit dose as needed. Such single dosage units may contain about $1 \times 10^9$ gc to about $1 \times 10^{15}$ gc.

Pharmaceutical compositions of the disclosure may be administered to a subject in need thereof, for example, one or more times (e.g., 1-10 times or more) daily, weekly, monthly, biannually, annually, or as medically necessary. In an exemplary embodiment, a single administration is sufficient. In one embodiment, a pharmaceutical composition comprising an expression cassette encoding an eTF that upregulates SCN1A or GRN is suitable for use in human subjects and is administered by intraparenchymal injection, intrathecal injection, intra-cisterna magna injection, or intracerebroventricular injection. In one embodiment, the pharmaceutical composition is delivered via a peripheral vein by bolus injection. In other embodiments, the pharmaceutical composition is delivered via a peripheral vein by infusion over about 10 minutes (±5 minutes), over about 20 minutes (±5 minutes), over about 30 minutes (±5 minutes), over about 60 minutes (±5 minutes), or over about 90 minutes (±10 minutes).

In another aspect, the application further provides a kit comprising a nucleic acid molecule, vector, host cell, virion or pharmaceutical composition as described herein in one or more containers. A kit may include instructions or packaging materials that describe how to administer a nucleic acid molecule, vector, host cell or virion contained within the kit to a patient. Containers of the kit can be of any suitable material, e.g., glass, plastic, metal, etc., and of any suitable size, shape, or configuration. In certain embodiments, the kits may include one or more ampoules or syringes that contain a nucleic acid molecule, vector, host cell, virion or pharmaceutical composition in a suitable liquid or solution form.

Methods of Treatment

In various embodiments, the application provides methods for using the eTFs disclosed herein. In certain embodiments, the application provides methods for administering an expression cassette, an expression vector, or a viral particle comprising a polynucleotide encoding an eTF disclosed herein to modulate expression of a gene of interest in a cell. In certain embodiments, the eTF can upregulate expression of the gene of interest. In other embodiments, the eTF can downregulate expression of the gene of interest. In various embodiments, the eTF may be used to modulate expression of a gene of interest in a cell in vitro, in vivo, or ex vivo.

In certain embodiments, the application provides methods for treating a disease or disorder associated with a gene of interest by administering an expression cassette, an expression vector, or a viral particle comprising a polynucleotide encoding an eTF that modulates expression of the gene of interest to a subject in need thereof. In exemplary embodiments, the disease or disorder is associated with haploinsufficiency of the gene of interest and the expression cassette, expression vector, or viral particle comprises a polynucleotide encoding an eTF that upregulates expression of the gene of interest. In certain embodiments, a method of treating a disease or disorder comprises administering an expression cassette, an expression vector, or a viral particle comprising a polynucleotide encoding an eTF that modulates expression of an endogenous gene of interest associated with such disease or disorder such that overexpression or under-expression of such gene is corrected, brought within a level of a healthy individual, or brought within a normal range as defined by a standard of medical care. In certain embodiments, the methods disclosed herein are used to treat a disease or disorder associated with an endogenous gene comprising one or more mutations that result in abnormal expression of the gene. In some cases, such endogenous gene is a gene that is too large to be delivered as a transgene in a gene therapy, or is inefficiently expressed when delivered as a transgene.

In certain embodiments, the application provides methods for ameliorating a symptom associated with a disease or disorder by administering an expression cassette, an expression vector, or a viral particle comprising a polynucleotide encoding an eTF that modulates expression of a gene associated with such disease or disorder to a subject in need thereof.

In an exemplary embodiment, the application provides methods for treating a disease, disorder or symptom with a mutation in SCN1A, a deficiency in Nav1.1 and/or reduced activity of Nav1.1 by administering to a subject in need thereof an expression cassette, an expression vector, or a viral particle comprising a polynucleotide encoding an eTF that upregulates expression of the SCN1A gene or its protein product Nav1.1. Voltage-gated sodium ion channels are important for the generation and propagation of action potentials in striated muscle and neuronal tissues. Voltage-gated sodium ion channels are heteromeric complexes consisting of a large central pore-forming glycosylated alpha subunit and 2 smaller auxiliary beta subunits. The large alpha subunit Nav1.1 subunit, encoded by the SCN1A gene, is relevant for a variety of diseases or disorders such as Dravet syndrome. Nav1.1 is expressed in neurons, and can be assembled with various beta subunits, including Navβ1 expressed by SCN1B gene.

In certain embodiments, the application provides methods for treating diseases associated with a mutation in SCN1A or reduced activity of Nav1.1 using an eTF that upregulates expression of the endogenous SCN1A gene. Diseases and disorders associated with SCN1A mutations include, but are not limited to: Dravet syndrome, Ohtahara syndrome, epilepsy, early infantile epileptic encephalopathy 6 (EIEE6), familial febrile seizures 3A (FEB3A), intractable childhood epilepsy with generalized tonic-clonic seizures (ICEGTC), migraine, familial hemiplegic 3 (FHM3), Panayiotopoulos syndrome, familial atrial fibrillation 13 (ATFB13), generalized epilepsy with febrile seizures plus type 1 (gefs+ type 1), Brugada syndrome, nonspecific cardiac conduction defect, generalized epilepsy with febrile seizures plus, benign familial infantile seizures, early infantile epileptic encephalopathy11 (EIEE11), benign familial infantile epilepsy, neurodegeneration, tauopathies and Alzheimer's disease. In some cases, the neurological condition is Dravet syndrome. Mutations or abnormalities in SCN1A have also been associated with seizure disorders, epilepsy, autism, familial hemiplegic migraine type 3 (FHM3), genetic epilepsy with febrile seizures plus (GEFS+), and effectiveness of certain anti-seizure medications. For instance, ICS5N+5G>A mutation in SCN1A is associated with the maximum safe amount (dose) of the anti-seizure drugs phenytoin and carbamazepine.

In certain embodiments, the application provides a method for treating a subject with, or at risk of developing, Dravet syndrome by administering an expression cassette, expression vector, or viral particle comprising a polynucleotide encoding an eTF that upregulates SCN1A. Dravet syndrome has been characterized by prolonged febrile and non-febrile seizures within the first year of a child's life. This disease progresses to other seizure types like myoclonic and partial seizures, psychomotor delay, and ataxia. It is characterized by cognitive impairment, behavioral disorders, and motor deficits. Behavioral deficits often include hyperactivity and impulsiveness, and in more rare cases, autistic-like behaviors. Dravet syndrome is also associated with sleep disorders including somnolence and insomnia. In many patients, Dravet syndrome is caused by genetic mutations that lead to the production of non-functional proteins. Many challenges exist in treating disorders associated with genetic causes. Thus, most of the existing treatments have been drawn to the prophylactic medical management of seizures and other symptoms.

In 70-90% of patients, Dravet syndrome is caused by nonsense mutations in the SCN1A gene resulting in a premature stop codon and thus a non-functional protein. Typically, a missense mutation in either the S5 or S6 segment of the sodium channel pore results in a loss of channel function and the development of Dravet syndrome. A heterozygous inheritance of an SCN1A mutation is all that is necessary to develop a defective sodium channel; patients with Dravet syndrome will still have one normal copy of the gene. Thus, the disease is characterized as one of haploinsufficiency and increasing expression of the functioning copy of SCN1A could restore normal production levels of Nav1.1.

Symptoms associated with Dravet syndrome include seizures, memory defects, developmental delay, poor muscle tone and/or cognitive problems. Treatment with an expression cassette, expression vector, or virial particle described herein can result in an improvement of one or more symptoms, such as a reduction in number, duration, and/or intensity of seizures. Administration of a gene therapy as described herein to a subject at risk of developing Dravet syndrome can prevent the development of or slow the progression of one or more symptoms of Dravet.

In certain embodiments, treatment with an expression cassette, expression vector, or virial particle comprising a polynucleotide encoding an eTF that upregulates SCN1A as described herein reduces seizure duration and/or frequency, e.g., seizures associated with Dravet syndrome, by at least 1%, 2%, 3%, 4%, 5%, 6%, 7%, 8%, 9%, 10%, 11%, 12%, 13%, 14%, 15%, 16%, 17%, 18%, 19%, 20%, 21%, 22%, 23%, 24%, 25%, 26%, 27%, 28%, 29%, 30%, 31%, 32%, 33%, 34%, 35%, 36%, 37%, 38%, 39%, 40%, 45%, 50%, 55%, 60%, 65%, 70%, 75%, 80%, 85%, 90%, 95% or more as compared to an untreated control or as compared to the level before treatment.

In some Alzheimer's patients, production of amyloid β (Aβ) involving many peptides and proteases that can affect excitability of neurons, causing seizures and downregulation of the Nav1.1 sodium channel in PV neurons. In another embodiment, the application provides methods for treating a subject suffering from Alzheimer's disease by administering an expression cassette, expression vector, or viral particle described herein that comprises a polynucleotide encoding an eTF that upregulates SCN1A. Symptoms associated with Alzheimer's disease include short term memory loss, cognitive difficulties, seizures, and difficulties with language, executive functions, perception (agnosia), and execution of movements (apraxia). Treatment with an expression cassette, expression vector, or viral particle comprising a polynucleotide encoding an eTF that upregulates SCN1A can result in an improvement of one or more Alzheimer's disease symptoms, such as a reduction in progression of memory loss, or the prevention of one or more symptoms. In some cases, the treatment can result in a correction of high gamma power brain activity. The treatment can result in a decrease in seizure frequency and/or seizure severity, or a decrease in high gamma power activity by at least 10%, 20%, 30%, 40%, 50%, 60%, 70% or more as compared to no treatment. In some cases, the treatment can result in an improvement in cognitive function. Learning and/or memory can be improved by at least 10%, 20%, 30%, 40%, 50%, 60%, 70%, 80%, 90%, 100% or more than 100% as compared to no treatment, or before the treatment with a polynucleotide encoding an eTF that upregulates SCN1A as disclosed herein.

In some cases, treatment with an expression cassette, expression vector, or viral particle comprising a polynucleotide encoding an eTF that upregulates SCN1A reduces high gamma power activity (e.g., high gamma power activity associated with Alzheimer's disease) by at least 1%, 2%, 3%, 4%, 5%, 6%, 7%, 8%, 9%, 10%, 11%, 12%, 13%, 14%, 15%, 16%, 17%, 18%, 19%, 20%, 21%, 22%, 23%, 24%, 25%, 26%, 27%, 28%, 29%, 30%, 31%, 32%, 33%, 34%, 35%, 36%, 37%, 38%, 39%, 40%, 45%, 50%, 55%, 60%, 65%, 70%, 75%, 80%, 85%, 90%, or 95% as compared to an untreated control or as compared to the level before treatment.

Parkinsonism refers to a collection of signs and symptoms found in Parkinson's disease (PD), including slowness (bradykinesia), stiffness (rigidity), tremor and imbalance (postural instability). In some cases, administration of an expression cassette, expression vector, or viral particle comprising a polynucleotide encoding an eTF that upregulates SCN1A as described herein to a subject at risk of developing or suffering from Parkinson's disease can prevent the development of one or more symptoms thereof or slow down the progression of Parkinson's disease by at least 10%, at least 20%, at least 30%, at least 40%, at least 50%, at least 60%, at least 70%, at least 80%, or at least 90% as compared to no treatment.

In certain embodiments, the application provides methods that can be used to treat a subject who is at risk of developing a disease. The subject can be known to be predisposed to a disease, for example, a neurological disease or a disease associated with epilepsy, seizures and/or encephalopathy. The subject can be predisposed to a disease due to a genetic event, or due to known risk factors. For example a subject can carry a mutation in SCN1A which is associated with Dravet syndrome. In some cases the subject can be predisposed to a disease such as Alzheimer's disease due to the age of the subject. In some cases, the subject may have an insufficient amount of SCN1A protein and treating a disease associated with SCN1A involves administering an expression cassette, expression vector, or viral particle comprising a polynucleotide encoding an eTF that upregulates endogenous SCN1A as described herein.

In certain embodiments, treatments using an expression cassette, expression vector, or viral particle comprising a polynucleotide encoding an eTF that upregulates endogenous SCN1A provided herein can result in a decrease or cessation of symptoms associated with Dravet or other SCN1A associated disease or disorders. For example, treatment can improve learning, memory, cognitive function, and/or motor function; reduce frequency and/or duration of seizures; and/or reduce temperature sensitivity (or increase the temperature threshold for triggering a seizure).

In another exemplary embodiment, the application provides methods for treating a disease or disorder associated with a mutation in the GRN gene or a deficiency in or reduced activity of GRN protein by administering to a subject in need thereof an expression cassette, an expression vector, or a viral particle comprising a polynucleotide encoding an eTF that upregulates expression of the GRN gene or protein product.

Progranulin is a cysteine-rich, secreted glycoprotein with growth factor-like properties and belongs to a family of granulin proteins. Granulins (e.g., granulin A to G and paragranulin) play a role in angiogenesis, wound repair, cell proliferation, and inflammation. Mutations in the granulin gene, or deficiency in secreted progranulin, are associated with various neurodegenerative diseases and metabolic diseases. Deficiency of the secreted granulin protein in the central nervous system (CNS) can lead to neurodegeneration, including frontotemporal lobar degeneration (FTLD); frontotemporal degeneration or frontotemporal dementia (FTD), an early-onset neurodegenerative disease associated with partial progranulin deficiency; progressive non-fluent aphasia (PNFA); semantic dementia; Parkinson's disease; Alzheimer's disease; and neuronal ceroid lipofuscinoisis (NCL) with total deficiency in progranulin. FTD refers to a group of complex neurodegenerative diseases characterized by progressive deterioration of the frontotemporal lobes that results in changes in behavior and/or speech, such as loss of motor coordination, social dysfunction, memory loss, and muscular tremors.

Generally, patients with one or more pathogenic mutations in one copy of the progranulin gene develop FTD, which is a subtype of FTLD. Clinical symptoms of FTLD include atrophy of the prefrontal and/or anterior temporal lobes, behavioral frontotemporal dementia, characterized by social and executive dysfunction, semantic dementia and progressive primary non fluent aphasia, with early language disturbances. FTD is an adult-onset behavioral disturbance followed by frontal lobe dementia, parkinsonism, and muscular atrophy.

Progranulin has also been implicated in metabolic diseases and is recognized as an adipokine involved in diet-induced obesity and insulin resistance. Mutation or deficiency in progranulin has been linked to atherosclerosis, a progressive disease characterized by a strong inflammatory component and thickening of the arterial walls due to accumulation of lipids and cell proliferation.

Mutations in GRN can include nonsense mutations, splice-site mutations; insertions and deletions that lead to a shift in the normal reading frame; and various point mutations. Nonsense, splice-site, and frameshift mutations can lead to haploinsufficiency due to mRNA nonsense-mediated decay or nuclear degradation of transcripts. Missense mutations have been observed in some sporadic FTLD, Alzheimer's disease, and amyotrophic lateral sclerosis (ALS) patients.

Various mutation in GRN that are associated with a disease or disorder are known and include mutations in the GRN coding region, e.g., −8+5G>C; −8+3A>T; 2T>C, 3G>A, 26CA(A9D); 63_64insC; 90_91insCTGC; 102ΔC; 138+1G>A; 154ΔA; 234_235ΔAG; 243ΔC; 361ΔG; 373C>T; 380_381ΔCT; 384_387ΔTAGT; 388_391ΔCAGT; 463-1G>A; 468_474ΔCTGCTGT; 675_676ΔCA; 708+1G>A; 707+1G>C; 709-2A>G; 759_760ΔTG; 813_816ΔCACT; 835_835+1insCTGA; 836-1G>C; 909ΔC; 910_911insTG; 911G>A; 933+1G>A; 942C>A; 998ΔG; 1095_1096ΔCT; 1145ΔC; 1157G>A; 1201C>T; 1231_1232ΔGT; 1232_1233insGT; 1252C>T; 1395_1296insC; 1402C>T; 1414-15 1590Δ; 1477C>T; or a combination thereof. See Eriksen J L, Mackenzie I R. Progranulin: normal function and role in neurodegeneration. *J Neurochem.* 2008 January; 104(2):287-97. Currently, there is no cure for such GRN-related neurodegenerative diseases and metabolic diseases. There is a need for treatment options that target GRN, e.g., therapies that increase progranulin levels and/or function in vivo.

In certain embodiments, an expression cassette, expression vector, or viral particle comprising a polynucleotide encoding an eTF that upregulates endogenous GRN expression as described herein may be used to treat a subject in need thereof, wherein the subject has any one or more of the GRN mutations listed above. In some cases, the subject in need thereof comprises a haploinsufficiency in GRN or a deficiency in GRN. In some cases, the subject in need thereof has or is at risk for FTD, Alzheimer's disease, Parkinson's disease, and/or atherosclerosis.

In certain embodiments, an expression cassette, expression vector, or viral particle comprising a polynucleotide encoding an eTF that upregulates endogenous GRN expression as described herein be administered to a subject with, or at risk of developing, FTD, Alzheimer's disease, Parkinson's disease, and/or atherosclerosis. In another example, the treatment may be administered to a subject suffering from FTD, Alzheimer's disease, Parkinson's disease, and/or atherosclerosis. Treatment with an expression cassette, expression vector, or viral particle comprising a polynucleotide encoding an eTF that upregulates endogenous GRN expression as described herein can result in an improvement of one or more symptoms associated with FTD, Alzheimer's disease, Parkinson's disease, and/or atherosclerosis, such as a reduction in one or more symptoms associated with behavioral and/or speech changes due to FTD, or a reduction in the thickness of the arterial walls in atherosclerosis. Other symptoms associated with GRN related central nervous system disorders include, for example, a presence of Lewy bodies, haploinsufficiency of progranulin (GRN), social deficit, lysosomal abnormality, loss of motor coordination, muscular tremors. In certain embodiments, the treatment can result in a restoration of GRN expression level or function by at least 5%, at least 10%, at least 20%, at least 30%, at least 40%, at least 50%, at least 60%, or at least 70% as compared to wild-type GRN. In certain embodiments, the treatment can result in an improvement in cognitive function, such as speech and/or memory improvement by at least 10%, at least 20%, at least 30%, at least 40%, at least 50%, at least 60%, at least 70%, at least 80%, at least 90%, at least 100%, or more than 100%, as compared to pre-treatment. In certain embodiments, treatment with an expression cassette, expression vector, or viral particle comprising a polynucleotide encoding an eTF that upregulates endogenous GRN expression as described herein can delay the symptoms or stop progression of the symptoms associated with FTD, Alzheimer's disease, Parkinson's disease, and/or atherosclerosis. In some cases, treatment with an expression cassette, expression vector, or viral particle comprising a polynucleotide encoding an eTF that upregulates endogenous GRN expression as described herein can increase cellular repair or reverse cellular damage in the CNS, the frontal cortex, or in the striatum by at least 10%, at least 20%, at least 30%, at least 40%, at least 50%, at least 60%, at least 70%, at least 80%, at least 90%, or at least 100% as compared to no treatment. In some cases, treating a GRN related central nervous system disorder comprises reducing the frequency and/or severity of muscular tremors.

In certain embodiments, an expression cassette, expression vector, or viral particle comprising a polynucleotide encoding an eTF that upregulates endogenous GRN expression as described herein can be used to treat a subject who has been diagnosed with a disease, for example, a neurological or neurodegenerative disease or a metabolic disease associated with GRN. The subject can be a patient suffering from FTD, Alzheimer's disease, Parkinson's disease, and/or atherosclerosis. In some aspects, the subject is a patient with FTD. The subject can be a patient suffering from a GRN-linked disease or condition, such as dementia or a metabolic disease. In some cases, genetic testing can be used to screen patients for mutations in the GRN gene. If the patient comprises a pathologic mutation in GRN, an expression cassette, expression vector, or viral particle comprising a polynucleotide encoding an eTF that upregulates endogenous GRN expression as described herein can be used to prevent, mitigate, or treat progression of the neurodegeneration or metabolic disease, e.g., FTD, Alzheimer's disease, Parkinson's disease, and/or atherosclerosis.

In certain embodiments, a subject treated with an expression cassette, expression vector, or viral particle comprising a polynucleotide encoding an eTF that upregulates endogenous GRN expression as described herein is one diagnosed with a mutation or genetic aberration in GRN. Such mutation can be homozygous or heterozygous, or an aberrant insertion, deletion, or substitution of one or more bases in the GRN gene that affect the protein expression, secretion, solubility, activity, and/or proteolytic cleavage in vivo.

In certain embodiments, an expression cassette, expression vector, or viral particle comprising a polynucleotide encoding an eTF that upregulates endogenous GRN expression as described herein may be used to treat a subject having or at risk for a neurodegenerative or a metabolic disease associated with a GRN mutation and/or deficiency to increase GRN expression and/or function in vivo in order to treat, prevent, or reduce the effects of the disease, e.g., FTLD, FTD, progressive non-fluent aphasia, semantic dementia, Parkinson's disease, Alzheimer's disease, NCL, diabetes, or atherosclerosis. In some cases, an expression cassette, expression vector, or viral particle comprising a polynucleotide encoding an eTF that upregulates endogenous GRN expression as described herein are used to treat, ameliorate, reduce, or manage symptoms of such diseases, e.g., speech impairment, social deficit, impaired motor skills or motor coordination, muscular atrophy, muscular tremors, neuronal atrophy, memory loss, parkinsonism, and/or lysosomal abnormality. In some cases, such compositions are used to decrease inflammation, decrease cell death, decrease neuronal atrophy, decrease motor neuron atrophy, and/or increase cellular repair in the CNS, or in the frontal cortex or the striatum in particular.

In certain embodiments, an expression cassette, expression vector, or viral particle comprising a polynucleotide encoding an eTF that upregulates endogenous GRN expression as described herein can be used to treat a subject who is at risk of developing a neurodegenerative or metabolic disease. The subject can be known to be predisposed to a disease, for example, a neurological or a metabolic disease through various screening or diagnostic methods, including methods that look for genetic mutations in GRN or blood tests for levels of the secreted GRN protein. The subject can be predisposed to a disease due to a genetic event, or due to known risk factors. For example a subject can carry a mutation in GRN which is associated with FTD, Alzheimer's disease, Parkinson's disease, and/or atherosclerosis. In some cases, the subject may have an insufficient amount of the GRN protein or isoforms thereof. For example, the subject may be known to have an insufficient amount of GRN protein.

The terms "subject" and "individual" are used interchangeably herein to refer to a vertebrate, preferably a mammal, more preferably a human. The methods described herein can be useful in human therapeutics, veterinary applications, and/or preclinical studies in animal models of a disease or condition. In various embodiments, a subject that can be treated in accordance with the methods described herein is a mammal, such as, for example, a mouse, rat, hamster, guinea pig, gerbil, cow, sheep, pig, goat, donkey, horse, dog, cat, llama, monkey (e.g., a macaque such as a Rhesus or cynomolgus), or human. In an exemplary embodiment, a subject is a human.

Following tables provide sequences disclosed herein.

TABLE 1

Genomic loci and protein sequences of SCN1A and GRN

| Chromosomal location of endogenous gene of interest | Protein SEQ ID NO. | Amino acid sequence (N-to-C terminus) |
|---|---|---|
| SCN1A base pairs 165,989,160 to 166,149,216 on chromosome 2 (Homo sapiens Annotation Release 109, GRCh38.p12) | SEQ ID NO: 180 | MEQTVLVPPGPDSFNFFTRESLAAIERRIAEEKAKNPKPDKKDDDENGPKPNSDLEA GKNLPFIYGDIPPEMVSEPLEDLDPYYINKKTFIVLNKGKAIFRFSATSALYILTPFNPL RKIAIKILVHSLFSMLIMCTILTNCVFMTMSNPPDWTKNVEYTFTGIYTFESLIKIIAR GFCLEDFTFLRDPWNWLDFTVITFAYVTEFVDLGNVSALRTFRVLRALKTISVIPGL KTIVGALIQSVKKLSDVMILTVFCLSVFALIGLQLFMGNLRNKCIQWPPTNASLEEHS IEKNITVNYNGTLINETVFEFDWKSYIQDSRYHYFLEGFLDALLCGNSSDAGQCPEG YMCVKAGRNPNYGYTSFDTFSWAFLSLFRLMTQDFWENLYQLTLRAAGKTYMIFF VLVIFLGSFYLINLILAVVAMAYEEQNQATLEEAEQKEAEFQQMIEQLKKQQEAAQ QAATATASEHSREPSAAGRLSDSSSEASKLSSKSAKERRNRRKKRKQKEQSGGEEK DEDEFQKSESEDSIRRKGFRFSIEGNRLTYEKRYSSPHQSLLSIRGSLFSPRRNSRTSLF SFRGRAKDVGSENDFADDEHSTFEDNESRRDSLFVPRRHGERRNSNLSQTSRSSRML AVFPANGKMHSTVDCNGVVSLVGGPSVPTSPVGQLLPEVIIDKPATDDNGTTTETE MRKRRSSSFHVSMDFLEDPSQRQRAMSIASILTNTVEELEESRQKCPPCWYKFSNIFL IWDCSPYWLKVKHVVNLVVMDPFVDLAITICIVLNTLFMAMEHYPMTDHFNNVLT VGNLVFTGIFTAEMFLKIIAMDPYYYFQEGWNIFDGFIVTLSLVELGLANVEGLSVLR SFRLLRVFKLAKSWPTLNMLIKIIGNSVGALGNLTLVLAIIVFIFAVVGMQLFGKSYK DCVCKIASDCQLPRWHMNDFFHSFLIVFRVLCGEWIETMWDCMEVAGQAMCLTVF MMVMVIGNLVVLNLFLALLLSSFSADNLAATDDDNEMNNLQIAVDRMHKGVAYV KRKIYEFIQQSFIRKQKILDEIKPLDDLNNKKDSCMSNHTAEIGKDLDYLKDVNGTTS GIGTGSSVEKYIIDESDYMSFINNPSLTVTVPIAVGESDFENLNTEDFSSESDLEESKE KLNESSSSSEGSTVDIGAPVEEQPVVEPEETLEPEACFTEGCVQRFKCCQINVEEGRG KQWWNLRRTCFRIVEHNWFETFIVFMILLSSGALAFEDIYIDQRKTIKTMLEYADKV FTYIFILEMLLKWVAYGYQTYFTNAWCWLDFLIVDVSLVSLTANALGYSELGAEKSL RTLRALRPLRALSRFEGMRVVVNALLGAIPSIMNVLLVCLIFWLIFSIMGVNLFAGKF YHCINTTTGDRFDIEDVNNHTDCLKLIERNETARWKNVKVNFDNVGFGYLSLLQVA TFKGWMDIMYAAVDSRNVELQPKYEESLYMYLYFVIFIIFGSFFTLNLFIGVIIDNFN |

TABLE 1-continued

Genomic loci and protein sequences of SCN1A and GRN

| Chromosomal location of endogenous gene of interest | Protein SEQ ID NO. | Amino acid sequence (N-to-C terminus) |
|---|---|---|
| | | QQKKKFGGQDIFMTEEQKKYYNAMKKLGSKKPQKPIPRPGNKFQGMVFDFVTRQV<br>FDISIMILICLNMVTMMVETDDQSEYVTTILSRINLVFIVLFTGECVLKLISLRHYYFTI<br>GWNIFDFVVVILSIVGIVIFLAELIEKYFVSPTLFRVIRLARIGRILRLIKGAKGIRTLLFA<br>LMMSLPALFNIGLLLFLVMFIYAIFGMSNFAYVKREVGIDDIVIFNFETFGNSMICLFQI<br>TTSAGWDGLLAPILNSKPPDCDPNKVNPGSSVKGDCGNPSVGIFFFVSYIIISFLVVV<br>NMYIAVILENFSVATEESAEPLSEDDFEIVIFYEVWEKFDPDATQFMEFEKLSQFAAAL<br>EPPLNLPQPNKLQLIAMDLPMVSGDRIHCLDILFAFTKRVLGESGEMDALRIQMEER<br>FMASNPSKVSYQPITTTLKRKQEEVSAVIIQRAYRRHLLKRTVKQASFTYNKNKIKG<br>GANLLIKEDMIIDRINENSITEKTDLTMSTAACPPSYDRVTKPIVEKHEQEGKDEKAK<br>GK |
| GRN<br>base pairs<br>44,345,086 to<br>44,353,106 on<br>chromosome 17<br>(Homo sapiens<br>Annotation<br>Release 109,<br>GRCh38.p12) | SEQ ID NO: 181 | MWTLVSWVALTAGLVAGTRCPDGQFCPVACCLDPGGASYSCCRPLLDKWPTT<br>LSRHLGGPCQVDAHCSAGHSCIFTVSGTSSCCPFPEAVACGDGHHCCPRGFHCS<br>ADGRSCFQRSGNNSVGAIQCPDSQFECPDFSTCCVMVDGSWGCCPMPQASCCE<br>DRVHCCPHGAFCDLVHTRCITPTGTHPLAKKLPAQRTNRAVALSSSVMCPDAR<br>SRCPDGSTCCELPSGKYGCCPMPNATCCSDHLHCCPQDTVCDLIQSKCLSKENA<br>TTDLLTKLPAHTVGDVKCDMEVSCPDGYTCCRLQSGAWGCCPFTQAVCCEDHI<br>HCCPAGFTCDTQKGTCEQGPHQVPWMEKAPAHLSLPDPQALKRDVPCDNVSS<br>CPSSDTCCQLTSGEWGCCPIPEAVCCSDHQHCCPQGYTCVAEGQCQRGSEIVAG<br>LEKMPARRASLSHPRDIGCDQHTSCPVGQTCCPSLGGSWACCQLPHAVCCEDR<br>QHCCPAGYTCNVKARSCEKEVVSAQPATFLARSPHVGVKDVECGEGHFCHDN<br>QTCCRDNRQGWACCPYRQGVCCADRRHCCPAGFRCAARGTKCLRREAPRWD<br>APLRDPALRQLL |

TABLE 2

Sequences of eTFs having high sequence identity to human EGR1/EGR3.

Amino Acid Sequence (N- to C-terminus)

Sequences of eTFs having high sequence identity to human EGR1

| SEQ ID NO: 1 | MAAAKAEMQLMSPLQISDPFGSFPHSPTMDNYPKLEEMMLLSNGAPQFLGAAGAPEGSGSNSSSSSG<br>GGGGGGGGSNSSSSSSTFNPQADTGEQPYEHLTAESFPDISLNNEKVLVETSYPSQTTRLPPITYTGRFS<br>LEPAPNSGNTLWPEPLFSLVSGLVSMTNPPASSSSAPSPAASSASASQSPPLSCAVPSNDSSPIYSAAPTF<br>PTPNTDIFPEPQSQAFPGSAGTALQYPPPAYPAAKGGFQVPMIPDYLFPQQQGDLGLGTPDQKPFQGLE<br>SRTQQPSLTPLSTIKAFATQSGSQDLKALNTSYQSQLIKPSRMRKYPNRPSKTPPHERPYACPVESCDRR<br>FSRSDELTRHIRIHTGQKPFQCRICMRNFSRSDHLTTHIRTHTGEKPFACDICGRKFARSDERKRHTKIH<br>LRQKDKKADKSVVASSATSSLSSYPSPVATSYPSPVTTSYPSPATTSYPSPVPTSFSSPGSSTYPSPVHSG<br>FPSPSVATTYSSVPPAFPAQVSSFPSSAVTNSFSASTGLSDMTATFSPRTIEIC |
|---|---|
| SEQ ID NO: 2 | MAAAKAEMQLMSPLQISDPFGSFPHSPTMDNYPKLEEMMLLSNGAPQFLGAAGAPEGSGSNSSSSSG<br>GGGGGGGGSNSSSSSSTFNPQADTGEQPYEHLTAESFPDISLNNEKVLVETSYPSQTTRLPPITYTGRFS<br>LEPAPNSGNTLWPEPLFSLVSGLVSMTNPPASSSSAPSPAASSASASQSPPLSCAVPSNDSSPIYSAAPTF<br>PTPNTDIFPEPQSQAFPGSAGTALQYPPPAYPAAKGGFQVPMIPDYLFPQQQGDLGLGTPDQKPFQGLE<br>SRTQQPSLTPLSTIKAFATQSGSQDLKALNTSYQSQLIKPSRMRKYPNRPSKTPPHELEPGEKPYKCPEC<br>GKSFSRRDELNVHQRTHTGEKPYKCPECGKSFSSRRTCRAHQRTHTGEKPYKCPECGKSFSQSSNLVR<br>HQRTHTGEKPYKCPECGKSFSQLAHLRAHQRTHTGEKPYKCPECGKSFSTSGNLVRHQRTHTGEKPY<br>KCPECGKSFSHRTTLTNHQRTHTGKKTSKKADKSVVASSATSSLSSYPSPVATSYPSPVTTSYPSPATTS<br>YPSPVPTSFSSPGSSTYPSPVHSGFPSPSVATTYSSVPPAFPAQVSSFPSSAVTNSFSASTGLSDMTATFSP<br>RTIEIC |
| SEQ ID NO: 3 | MAAAKAEMQLMSPLQISDPFGSFPHSPTMDNYPKLEEMMLLSNGAPQFLGAAGAPEGSGSNSSSSSG<br>GGGGGGGGSNSSSSSSTFNPQADTGEQPYEHLTAESFPDISLNNEKVLVETSYPSQTTRLPPITYTGRFS<br>LEPAPNSGNTLWPEPLFSLVSGLVSMTNPPASSSSAPSPAASSASASQSPPLSCAVPSNDSSPIYSAAPTF<br>PTPNTDIFPEPQSQAFPGSAGTALQYPPPAYPAAKGGFQVPMIPDYLFPQQQGDLGLGTPDQKPFQGLE<br>SRTQQPSLTPLSTIKAFATQSGSQDLKALNTSYQSQLIKPSRMRKYPNRPSKTPPHERPYACPVESCDRR<br>FSQLAHLRAHIRIHTGQKPFQCRICMRNFSTSGNLVRHIRTHTGEKPFACDICGRKFAHRTTLTNHTKIH<br>LRQKDKKADKSVVASSATSSLSSYPSPVATSYPSPVTTSYPSPATTSYPSPVPTSFSSPGSSTYPSPVHSG<br>FPSPSVATTYSSVPPAFPAQVSSFPSSAVTNSFSASTGLSDMTATFSPRTIEIC |
| SEQ ID NO: 4 | MAAAKAEMQLMSPLQISDPFGSFPHSPTMDNYPKLEEMMLLSNGAPQFLGAAGAPEGSGSNSSSSSG<br>GGGGGGGGSNSSSSSSTFNPQADTGEQPYEHLTAESFPDISLNNEKVLVETSYPSQTTRLPPITYTGRFS<br>LEPAPNSGNTLWPEPLFSLVSGLVSMTNPPASSSSAPSPAASSASASQSPPLSCAVPSNDSSPIYSAAPTF<br>PTPNTDIFPEPQSQAFPGSAGTALQYPPPAYPAAKGGFQVPMIPDYLFPQQQGDLGLGTPDQKPFQGLE<br>SRTQQPSLTPLSTIKAFATQSGSQDLKALNTSYQSQLIKPSRMRKYPNRPSKTPPHERPYACPVESCDRR<br>FSRRDELNVHIRIHTGQKPFQCRICMRNFSSRRTCRAHIRTHTGEKPFACDICGRKFAQSSNLVRHTKIH |

TABLE 2-continued

Sequences of eTFs having high sequence identity to human EGR1/EGR3.

Amino Acid Sequence (N- to C-terminus)

| | |
|---|---|
| | LRQKDRPYACPVESCDRRFSQLAHLRAHIRIHTGQKPFQCRICMRNFSTSGNLVRHIRTHTGEKPFACD<br>ICGRKFAHRTTLTNHTKIHLRQKDKKADKSVVASSATSSLSSYPSPVATSYPSPVTTSYPSPATTSYPSP<br>VPTSFSSPGSSTYPSPVHSGFPSPSVATTYSSVPPAFPAQVSSFPSSAVTNSFSASTGLSDMTATFSPRTIEI<br>C |
| SEQ ID<br>NO: 5 | MAAAKAEMQLMSPLQISDPFGSFPHSPTMDNYPKLEEMMLLSNGAPQFLGAAGAPEGSGSNSSSSSSG<br>GGGGGGGGSNSSSSSSTFNPQADTGEQPYEHLTAESFPDISLNNEKVLVETSYPSQTTRLPPITYTGRFS<br>LEPAPNSGNTLWPEPLFSLVSGLVSMTNPPASSSSAPSPAASSASASQSPPLSCAVPSNDSSPIYSAAPTF<br>PTPNTDIFPEPQSQAFPGSAGTALQYPPPAYPAAKGGFQVPMIPDYLFPQQQGDLGLGTPDQKPFQGLE<br>SRTQQPSLTPLSTIKAFATQSGSQDLKALNTSYQSQLIKPSRMRKYPNRPSKTPPHERPYACPVESCDRR<br>FSRRDELNVHIRIHTGQKPFQCRICMRNFSSRRTCRAHIRTHTGEKPFACDICGRKFAQSSNLVRHIRTH<br>TGEKPFACDICGRKFSQLAHLRAHIRIHTGQKPFQCRICMRNFSTSGNLVRHIRTHTGEKPFACDICGRK<br>FAHRTTLTNHTKIHLRQKDKKADKSVVASSATSSLSSYPSPVATSYPSPVTTSYPSPATTSYPSPVPTSFS<br>SPGSSTYPSPVHSGFPSPSVATTYSSVPPAFPAQVSSFPSSAVTNSFSASTGLSDMTATFSPRTIEIC |
| SEQ ID<br>NO: 6 | MAAAKAEMQLMSPLQISDPFGSFPHSPTMDNYPKLEEMMLLSNGAPQFLGAAGAPEGSGSNSSSSSSG<br>GGGGGGGGSNSSSSSSTFNPQADTGEQPYEHLTAESFPDISLNNEKVLVETSYPSQTTRLPPITYTGRFS<br>LEPAPNSGNTLWPEPLFSLVSGLVSMTNPPASSSSAPSPAASSASASQSPPLSCAVPSNDSSPIYSAAPTF<br>PTPNTDIFPEPQSQAFPGSAGTALQYPPPAYPAAKGGFQVPMIPDYLFPQQQGDLGLGTPDQKPFQGLE<br>SRTQQPSLTPLSTIKAFATQSGSQDLKALNTSYQSQLIKPSRMRKYPNRPSKTPPHERPYACPVESCDRR<br>FSRSDNLVRHIRIHTGQKPFQCRICMRNFSREDNLHTHIRTHTGEKPFACDICGRKFARSDELVRHTKIH<br>LRQKDRPYACPVESCDRRFSQSGNLTEHIRIHTGQKPFQCRICMRNFSTSGHLVRHIRTHTGEKPFACDI<br>CGRKFAQNSTLTEHTKIHLRQKDKKADKSVVASSATSSLSSYPSPVATSYPSPVTTSYPSPATTSYPSPV<br>PTSFSSPGSSTYPSPVHSGFPSPSVATTYSSVPPAFPAQVSSFPSSAVTNSFSASTGLSDMTATFSPRTIEIC |
| SEQ ID<br>NO: 7 | MAAAKAEMQLMSPLQISDPFGSFPHSPTMDNYPKLEEMMLLSNGAPQFLGAAGAPEGSGSNSSSSSSG<br>GGGGGGGGSNSSSSSSTFNPQADTGEQPYEHLTAESFPDISLNNEKVLVETSYPSQTTRLPPITYTGRFS<br>LEPAPNSGNTLWPEPLFSLVSGLVSMTNPPASSSSAPSPAASSASASQSPPLSCAVPSNDSSPIYSAAPTF<br>PTPNTDIFPEPQSQAFPGSAGTALQYPPPAYPAAKGGFQVPMIPDYLFPQQQGDLGLGTPDQKPFQGLE<br>SRTQQPSLTPLSTIKAFATQSGSQDLKALNTSYQSQLIKPSRMRKYPNRPSKTPPHERPYACPVESCDRR<br>FSRSDNLVRHIRIHTGQKPFQCRICMRNFSHRTTLTNHIRTHTGEKPFACDICGRKFAREDNLHTHTKIH<br>LRQKDRPYACPVESCDRRFSTSHSLTEHIRIHTGQKPFQCRICMRNFSQSSSLVRHIRTHTGEKPFACDI<br>CGRKFAREDNLHTHTKIHLRQKDKKADKSVVASSATSSLSSYPSPVATSYPSPVTTSYPSPATTSYPSP<br>VPTSFSSPGSSTYPSPVHSGFPSPSVATTYSSVPPAFPAQVSSFPSSAVTNSFSASTGLSDMTATFSPRTIEI<br>C |
| SEQ ID<br>NO: 8 | MAAAKAEMQLMSPLQISDPFGSFPHSPTMDNYPKLEEMMLLSNGAPQFLGAAGAPEGSGSNSSSSSSG<br>GGGGGGGGSNSSSSSSTFNPQADTGEQPYEHLTAESFPDISLNNEKVLVETSYPSQTTRLPPITYTGRFS<br>LEPAPNSGNTLWPEPLFSLVSGLVSMTNPPASSSSAPSPAASSASASQSPPLSCAVPSNDSSPIYSAAPTF<br>PTPNTDIFPEPQSQAFPGSAGTALQYPPPAYPAAKGGFQVPMIPDYLFPQQQGDLGLGTPDQKPFQGLE<br>SRTQQPSLTPLSTIKAFATQSGSQDLKALNTSYQSQLIKPSRMRKYPNRPSKTPPHERPYACPVESCDRR<br>FSRSDNLVRHIRIHTGQKPFQCRICMRNFSHRTTLTNHIRTHTGEKPFACDICGRKFSTSHSLTEHIRIHT<br>GQKPFQCRICMRNFSQSSSLVRHIRTHTGEKPFACDICGRKF<br>AREDNLHTHTKIHLRQKDKKADKSVVASSATSSLSSYPSPVATSYPSPVTTSYPSPATTSYPSPVPTSFS<br>SPGSSTYPSPVHSGFPSPSVATTYSSVPPAFPAQVSSFPSSAVTNSFSASTGLSDMTATFSPRTIEIC |
| SEQ ID<br>NO: 9 | MAAAKAEMQLMSPLQISDPFGSFPHSPTMDNYPKLEEMMLLSNGAPQFLGAAGAPEGSGSNSSSSSSG<br>GGGGGGGGSNSSSSSSTFNPQADTGEQPYEHLTAESFPDISLNNEKVLVETSYPSQTTRLPPITYTGRFS<br>LEPAPNSGNTLWPEPLFSLVSGLVSMTNPPASSSSAPSPAASSASASQSPPLSCAVPSNDSSPIYSAAPTF<br>PTPNTDIFPEPQSQAFPGSAGTALQYPPPAYPAAKGGFQVPMIPDYLFPQQQGDLGLGTPDQKPFQGLE<br>SRTQQPSLTPLSTIKAFATQSGSQDLKALNTSYQSQLIKPSRMRKYPNRPSKTPPHERPYACPVESCDRR<br>FSRRDELNVHIRIHTGQKPFQCRICMRNFSRSDHLTNHIRTHTGEKPFACDICGRKFARSDDLVRHTKIH<br>LRQKDRPYACPVESCDRRFSRSDNLVRHIRIHTGQKPFQCRICMRNFSHRTTLTNHIRTHTGEKPFACDI<br>CGRKFAREDNLHTHTKIHLRQKDRPYACPVESCDRRFSTSHSLTEHIRIHTGQKPFQCRICMRNFSQSSS<br>LVRHIRTHTGEKPFACDICGRKFAREDNLHTHTKIHLRQKDKKADKSVVASSATSSLSSYPSPVATSYP<br>SPVTTSYPSPATTSYPSPVPTSFSSPGSSTYPSPVHSGFPSPSVATTYSSVPPAFPAQVSSFPSSAVTNSFSA<br>STGLSDMTATFSPRTIEIC |
| SEQ ID<br>NO: 10 | MAAAKAEMQLMSPLQISDPFGSFPHSPTMDNYPKLEEMMLLSNGAPQFLGAAGAPEGSGSNSSSSSSG<br>GGGGGGGGSNSSSSSSTFNPQADTGEQPYEHLTAESFPDISLNNEKVLVETSYPSQTTRLPPITYTGRFS<br>LEPAPNSGNTLWPEPLFSLVSGLVSMTNPPASSSSAPSPAASSASASQSPPLSCAVPSNDSSPIYSAAPTF<br>PTPNTDIFPEPQSQAFPGSAGTALQYPPPAYPAAKGGFQVPMIPDYLFPQQQGDLGLGTPDQKPFQGLE<br>SRTQQPSLTPLSTIKAFATQSGSQDLKALNTSYQSQLIKPSRMRKYPNRPSKTPPHERPYACPVESCDRR<br>FSSPADLTRHIRIHTGQKPFQCRICMRNFSDSGNLRVHIRTHTGEKPFACDICGRKFAQLAHLRAHTKIH<br>LRQKDRPYACPVESCDRRFSQRANLRAHIRIHTGQKPFQCRICMRNFSREDNLHTHIRTHTGEKPFACD<br>ICGRKFARSDNLVRHTKIHLRQKDKKADKSVVASSATSSLSSYPSPVATSYPSPVTTSYPSPATTSYPSP<br>VPTSFSSPGSSTYPSPVHSGFPSPSVATTYSSVPPAFPAQVSSFPSSAVTNSFSASTGLSDMTATFSPRTIEI<br>C |
| SEQ ID<br>NO: 325 | MAAAKAEMQLMSPLQISDPFGSFPHSPTMDNYPKLEEMMLLSNGAPQFLGAAGAPEGSGSNSSSSSSG<br>GGGGGGGGSNSSSSSSTFNPQADTGEQPYEHLTAESFPDISLNNEKVLVETSYPSQTTRLPPITYTGRFS<br>LEPAPNSGNTLWPEPLFSLVSGLVSMTNPPASSSSAPSPAASSASASQSPPLSCAVPSNDSSPIYSAAPTF<br>PTPNTDIFPEPQSQAFPGSAGTALQYPPPAYPAAKGGFQVPMIPDYLFPQQQGDLGLGTPDQKPFQGLE<br>SRTQQPSLTPLSTIKAFATQSGSQDLKALNTSYQSQLIKPSRMRKYPNRPSKTPPHERPYACPVESCDRR<br>FSRSDNLVRHIRIHTGQKPFQCRICMRNFSHRTTLTNHIRTHTGEKPFACDICGRKFAREDNLHTHIRTH<br>TGEKPFACDICGRKFSTSHSLTEHIRIHTGQKPFQCRICMRNFSQSSSLVRHIRTHTGEKPFACDICGRKF |

TABLE 2-continued

Sequences of eTFs having high sequence identity to human EGR1/EGR3.

Amino Acid Sequence (N- to C-terminus)

AREDNLHTHTKIHLRQKDKKADKSVVASSATSSLSSYPSPVATSYPSPVTTSYPSPATTSYPSPVPTSFS
SPGSSTYPSPVHSGFPSPSVATTYSSVPPAFPAQVSSFPSSAVTNSFSASTGLSDMTATFSPRTIEIC

Sequences of eTFs having high sequence identity to human EGR3

| | |
|---|---|
| SEQ ID NO: 11 | MTGKLAEKLPVTMSSLLNQLPDNLYPEEIPSALNLFSGSSDSVVHYNQMATENVMDIGLTNEKPNPEL SYSGSFQPAPGNKTVTYLGKFAFDSPSNWCQDNIISLMSAGILGVPPASGALSTQTSTASMVQPPQGDV EAMYPALPPYSNCGDLYSEPVSFHDPQGNPGLAYSPQDYQSAKPALDSNLFPMIPDYNLYHHPNDMG SIPEHKPFQGMDPIRVNPPPITPLETIKAFKDKQIHPGFGSLPQPPLTLKPIRPRKYPNRPSKTPLHERPHA CPAEGCDRRFSQLAHLRAHLRIHTGHKPFQCRICMRSFSTSGNLVRHIRTHTGEKPFACEFCGRKFAHR TTLTNHAKIHLKQKEKKAEKGGAPSASSAPPVSLAPVVTTCA |
| SEQ ID NO: 12 | MTGKLAEKLPVTMSSLLNQLPDNLYPEEIPSALNLFSGSSDSVVHYNQMATENVMDIGLTNEKPNPEL SYSGSFQPAPGNKTVTYLGKFAFDSPSNWCQDNIISLMSAGILGVPPASGALSTQTSTASMVQPPQGDV EAMYPALPPYSNCGDLYSEPVSFHDPQGNPGLAYSPQDYQSAKPALDSNLFPMIPDYNLYHHPNDMG SIPEHKPFQGMDPIRVNPPPITPLETIKAFKDKQIHPGFGSLPQPPLTLKPIRPRKYPNRPSKTPLHERPHA CPAEGCDRRFSRRDELNVHLRIHTGHKPFQCRICMRSFSSRRTCRAHIRTHTGEKPFACEFCGRKFAQS SNLVRHAKIHLKQKEHACPAEGCDRRFSQLAHLRAHLRIHTGHKPFQCRICMRSFSTSGNLVRHIRTHT GEKPFACEFCGRKFAHRTTLTNHAKIHLKQKEKKAEKGGAPSASSAPPVSLAPVVTTCA |
| SEQ ID NO: 13 | MTGKLAEKLPVTMSSLLNQLPDNLYPEEIPSALNLFSGSSDSVVHYNQMATENVMDIGLTNEKPNPEL SYSGSFQPAPGNKTVTYLGKFAFDSPSNWCQDNIISLMSAGILGVPPASGALSTQTSTASMVQPPQGDV EAMYPALPPYSNCGDLYSEPVSFHDPQGNPGLAYSPQDYQSAKPALDSNLFPMIPDYNLYHHPNDMG SIPEHKPFQGMDPIRVNPPPITPLETIKAFKDKQIHPGFGSLPQPPLTLKPIRPRKYPNRPSKTPLHERPHA CPAEGCDRRFSRSDNLVRHLRIHTGHKPFQCRICMRSFSREDNLHTHIRTHTGEKPFACEFCGRKFARS DELVRHAKIHLKQKEHACPAEGCDRRFSQSGNLTEHLRIHTGHKPFQCRICMRSFSTSGHLVRHIRTHT GEKPFACEFCGRKFAQNSTLTEHAKIHLKQKEKKAEKGGAPSASSAPPVSLAPVVTTCA |
| SEQ ID NO: 14 | MTGKLAEKLPVTMSSLLNQLPDNLYPEEIPSALNLFSGSSDSVVHYNQMATENVMDIGLTNEKPNPEL SYSGSFQPAPGNKTVTYLGKFAFDSPSNWCQDNIISLMSAGILGVPPASGALSTQTSTASMVQPPQGDV EAMYPALPPYSNCGDLYSEPVSFHDPQGNPGLAYSPQDYQSAKPALDSNLFPMIPDYNLYHHPNDMG SIPEHKPFQGMDPIRVNPPPITPLETIKAFKDKQIHPGFGSLPQPPLTLKPIRPRKYPNRPSKTPLHERPHA CPAEGCDRRFSRSDNLVRHLRIHTGHKPFQCRICMRSFSHRTTLTNHIRTHTGEKPFACEFCGRKFARE DNLHTHAKIHLKQKEHACPAEGCDRRFSTSHSLTEHLRIHTGHKPFQCRICMRSFSQSSSLVRHIRTHT GEKPFACEFCGRKFAREDNLHTHAKIHLKQKEKKAEKGGAPSASSAPPVSLAPVVTTCA |
| SEQ ID NO: 15 | MTGKLAEKLPVTMSSLLNQLPDNLYPEEIPSALNLFSGSSDSVVHYNQMATENVMDIGLTNEKPNPEL SYSGSFQPAPGNKTVTYLGKFAFDSPSNWCQDNIISLMSAGILGVPPASGALSTQTSTASMVQPPQGDV EAMYPALPPYSNCGDLYSEPVSFHDPQGNPGLAYSPQDYQSAKPALDSNLFPMIPDYNLYHHPNDMG SIPEHKPFQGMDPIRVNPPPITPLETIKAFKDKQIHPGFGSLPQPPLTLKPIRPRKYPNRPSKTPLHERPHA CPAEGCDRRFSRRDELNVHLRIHTGHKPFQCRICMRSFSRSDHLTNHIRTHTGEKPFACEFCGRKFARS DDLVRHAKIHLKQKEHACPAEGCDRRFSRSDNLVRHLRIHTGHKPFQCRICMRSFSHRTTLTNHIRTHT GEKPFACEFCGRKFAREDNLHTHAKIHLKQKEHACPAEGCDRRFSTSHSLTEHLRIHTGHKPFQCRIC MRSFSQSSSLVRHIRTHTGEKPFACEFCGRKFAREDNLHTHAKIHLKQKEKKAEKGGAPSASSAPPVSL APVVTTCA |
| SEQ ID NO: 16 | MTGKLAEKLPVTMSSLLNQLPDNLYPEEIPSALNLFSGSSDSVVHYNQMATENVMDIGLTNEKPNPEL SYSGSFQPAPGNKTVTYLGKFAFDSPSNWCQDNIISLMSAGILGVPPASGALSTQTSTASMVQPPQGDV EAMYPALPPYSNCGDLYSEPVSFHDPQGNPGLAYSPQDYQSAKPALDSNLFPMIPDYNLYHHPNDMG SIPEHKPFQGMDPIRVNPPPITPLETIKAFKDKQIHPGFGSLPQPPLTLKPIRPRKYPNRPSKTPLHERPHA CPAEGCDRRFSSPADLTRHLRIHTGHKPFQCRICMRSFSDSGNLVRHIRTHTGEKPFACEFCGRKFAQL AHLRAHAKIHLKQKEHACPAEGCDRRFSQRANLRAHLRIHTGHKPFQCRICMRSFSREDNLHTHIRTH TGEKPFACEFCGRKFARSDNLVRHAKIHLKQKEKKAEKGGAPSASSAPPVSLAPVVTTCA |

TABLE 3

DBD Sequences of eTFs disclosed in TABLE 2

| eTF | DBD SEQ ID NO: | Amino Acid Sequence of the DBD (N- to C-terminus) |
|---|---|---|
| \multicolumn{3}{l}{DBD sequences of eTFs having high sequence identity to EGR1} |
| SEQ ID NO: 1 | SEQ ID NO: 17 | RPYACPVESCDRRFSRSDELTRHIRIHTGQKPFQCRICMRNFSRSDHLTTHIRTHTGEKP FACDICGRKFARSDERKRHTKIHLRQKD |
| SEQ ID NO: 2 | SEQ ID NO: 18 | LEPGEKPYKCPECGKSFSRRDELNVHQRTHTGEKPYKCPECGKSFSSRRTCRAHQRTH TGEKPYKCPECGKSFSQSSNLVRHQRTHTGEKPYKCPECGKSFSQLAHLRAHQRTHTG EKPYKCPECGKSFSTSGNLVRHQRTHTGEKPYKCPECGKSFSHRTTLTNHQRTHTGKK TS |
| SEQ ID NO: 3 | SEQ ID NO: 19 | RPYACPVESCDRRFSQLAHLRAHIRIHTGQKPFQCRICMRNFSTSGNLVRHIRTHTGEK PFACDICGRKFAHRTTLTNHTKIHLRQKD |

TABLE 3-continued

DBD Sequences of eTFs disclosed in TABLE 2

| eTF | DBD SEQ ID NO: | Amino Acid Sequence of the DBD (N- to C-terminus) |
|---|---|---|
| SEQ ID NO: 4 | SEQ ID NO: 20 | RPYACPVESCDRRFSRRDELNVHIRIHTGQKPFQCRICMRNFSSRRTCRAHIRTHTGEKP FACDICGRKFAQSSNLVRHTKIHLRQKDRPYACPVESCDRRFSQLAHLRAHIRIHTGQK PFQCRICMRNFSTSGNLVRHIRTHTGEKPFACDICGRKFAHRTTLTNHTKIHLRQKD |
| SEQ ID NO: 5 | SEQ ID NO: 21 | RPYACPVESCDRRFSRRDELNVHIRIHTGQKPFQCRICMRNFSSRRTCRAHIRTHTGEKP FACDICGRKFAQSSNLVRHIRTHTGEKPFACDICGRKFSQLAHLRAHIRIHTGQKPFQCR ICMRNFSTSGNLVRHIRTHTGEKPFACDICGRKFAHRTTLTNHTKIHLRQKD |
| SEQ ID NO: 6 | SEQ ID NO: 22 | RPYACPVESCDRRFSRSDNLVRHIRIHTGQKPFQCRICMRNFSREDNLHTHIRTHTGEK PFACDICGRKFARSDELVRHTKIHLRQKDRPYACPVESCDRRFSQSGNLTEHIRIHTGQ KPFQCRICMRNFSTSGHLVRHIRTHTGEKPFACDICGRKFAQNSTLTEHTKIHLRQKD |
| SEQ ID NO: 7 | SEQ ID NO: 23 | RPYACPVESCDRRFSRSDNLVRHIRIHTGQKPFQCRICMRNFSHRTTLTNHIRTHTGEKP FACDICGRKFAREDNLHTHTKIHLRQKDRPYACPVESCDRRFSTSHSLTEHIRIHTGQKP FQCRICMRNFSQSSSLVRHIRTHTGEKPFACDICGRKFAREDNLHTHTKIHLRQKD |
| SEQ ID NO: 8 | SEQ ID NO: 24 | RPYACPVESCDRRFSRSDNLVRHIRIHTGQKPFQCRICMRNFSHRTTLTNHIRTHTGEKP FACDICGRKFAREDNLHTHIRTHTGEKPFACDICGRKFSTSHSLTEHIRIHTGQKPFQCRI CMRNFSQSSSLVRHIRTHTGEKPFACDICGRKFAREDNLHTHTKIHLRQKD |
| SEQ ID NO: 9 | SEQ ID NO: 25 | RPYACPVESCDRRFSRRDELNVHIRIHTGQKPFQCRICMRNFSRSDHLTNHIRTHTGEK PFACDICGRKFARSDDLVRHTKIHLRQKDRPYACPVESCDRRFSRSDNLVRHIRIHTGQ KPFQCRICMRNFSHRTTLTNHIRTHTGEKPFACDICGRKFAREDNLHTHTKIHLRQKDR PYACPVESCDRRFSTSHSLTEHIRIHTGQKPFQCRICMRNFSQSSSLVRHIRTHTGEKPFA CDICGRKFAREDNLHTHTKIHLRQKD |
| SEQ ID NO: 10 | SEQ ID NO: 26 | RPYACPVESCDRRFSSPADLTRHIRIHTGQKPFQCRICMRNFSDSGNLRVHIRTHTGEKP FACDICGRKFAQLAHLRAHTKIHLRQKDRPYACPVESCDRRFSQRANLRAHIRIHTGQ KPFQCRICMRNFSREDNLHTHIRTHTGEKPFACDICGRKFARSDNLVRHTKIHLRQKD |
| SEQ ID NO: 325 | SEQ ID NO: 351 | RKYPNRPSKTPPHERPYACPVESCDRRFSRSDNLVRHIRIHTGQKPFQCRICMRNFSHR TTLTNHIRTHTGEKPFACDICGRKFAREDNLHTHIRTHTGEKPFACDICGRKFSTSHSLT EHIRIHTGQKPFQCRICMRNFSQSSSLVRHIRTHTGEKPFACDICGRKFAREDNLHTHTK ITILRQKDKKADKSVV |

DBD sequences of eTFs having high sequence identity to EGR3

| SEQ ID NO: 11 | SEQ ID NO: 27 | PHACPAEGCDRRFSQLAHLRAHLRIHTGHKPFQCRICMRSFSTSGNLVRHIRTHTGEKP FACEFCGRKFAHRTTLTNHAKIHLKQKE |
| SEQ ID NO: 12 | SEQ ID NO: 28 | HACPAEGCDRRFSRRDELNVHLRIHTGHKPFQCRICMRSFSSRRTCRAHIRTHTGEKPF ACEFCGRKFAQSSNLVRHAKIHLKQKEHACPAEGCDRRFSQLAHLRAHLRIHTGHKPF QCRICMRSFSTSGNLVRHIRTHTGEKPFACEFCGRKFAHRTTLTNHAKIHLKQKE |
| SEQ ID NO: 13 | SEQ ID NO: 29 | PHACPAEGCDRRFSRSDNLVRHLRIHTGHKPFQCRICMRSFSREDNLHTHIRTHTGEKP FACEFCGRKFARSDELVRHAKIHLKQKEHACPAEGCDRRFSQSGNLTEHLRIHTGHKP FQCRICMRSFSTSGHLVRHIRTHTGEKPFACEFCGRKFAQNSTLTEHAKIHLKQKE |
| SEQ ID NO: 14 | SEQ ID NO: 30 | PHACPAEGCDRRFSRSDNLVRHLRIHTGHKPFQCRICMRSFSHRTTLTNHIRTHTGEKP FACEFCGRKFAREDNLHTHAKIHLKQKEHACPAEGCDRRFSTSHSLTEHLRIHTGHKPF QCRICMRSFSQSSSLVRHIRTHTGEKPFACEFCGRKFAREDNLHTHAKIHLKQKE |
| SEQ ID NO: 15 | SEQ ID NO: 31 | PHACPAEGCDRRFSRRDELNVHLRIHTGHKPFQCRICMRSFSRSDHLTNHIRTHTGEKP FACEFCGRKFARSDDLVRHAKIHLKQKEHACPAEGCDRRFSRSDNLVRHLRIHTGHKP FQCRICMRSFSHRTTLTNHIRTHTGEKPFACEFCGRKFAREDNLHTHAKIHLKQKEHAC PAEGCDRRFSTSHSLTEHLRIHTGHKPFQCRICMRSFSQSSSLVRHIRTHTGEKPFACEF CGRKFAREDNLHTHAKIHLKQKE |
| SEQ ID NO: 16 | SEQ ID NO: 32 | PHACPAEGCDRRFSSPADLTRHLRIHTGHKPFQCRICMRSFSDSGNLRVHIRTHTGEKP FACEFCGRKFAQLAHLRAHAKIHLKQKEHACPAEGCDRRFSQRANLRAHLRIHTGHK PFQCRICMRSFSREDNLHTHIRTHTGEKPFACEFCGRKFARSDNLVRHAKIHLKQKE |

TABLE 4

Target site sequences recognized by eTFs disclosed in TABLE 2

| eTF | Protein Platform for eTF | Target site SEQ IDNO: | Target binding site sequence (5'-to-3') | Gene Target | NCBI-BLAST sequence identity to protein platform |
|---|---|---|---|---|---|
| SEQ ID NO: 1 | WT EGR1 | N/A | N/A | N/A | 100% |
| SEQ ID NO: 2 | EGR1 | SEQ ID NO: 33 | AGTGATAGAGAACGTATG | Reporter | 87% |
| SEQ ID NO: 3 | EGR1 | SEQ ID NO: 34 | AGTGATAGA | Reporter | 97% |
| SEQ ID NO: 4 | EGR1 | SEQ ID NO: 33 | AGTGATAGAGAACGTATG | Reporter | 96% |
| SEQ ID NO: 5 | EGR1 | SEQ ID NO: 33 | AGTGATAGAGAACGTATG | Reporter | 94% |
| SEQ ID NO: 6 | EGR1 | SEQ ID NO: 35 | CTAGGTCAAGTGTAGGAG | SCN1A | 97% |
| SEQ ID NO: 7 | EGR1 | SEQ ID NO: 36 | TAGGTACCATAGAGTGAG | SCN1A | 96% |
| SEQ ID NO: 8 | EGR1 | SEQ ID NO: 36 | TAGGTACCATAGAGTGAG | SCN1A | 94% |
| SEQ ID NO: 9 | EGR1 | SEQ ID NO: 37 | TAGGTACCATAGAGTGAGGCGAGGATG | SCN1A | 97% |
| SEQ ID NO: 10 | EGR1 | SEQ ID NO: 38 | GAGTAGAAAAGAAACACA | GRN | 95% |
| SEQ ID NO: 11 | EGR3 | SEQ ID NO: 33 | AGT GAT AGA GAA CGT ATG | Reporter | 94% |
| SEQ ID NO: 12 | EGR3 | SEQ ID NO: 33 | AGT GAT AGA GAA CGT ATG | Reporter | 96% |
| SEQ ID NO: 13 | EGR3 | SEQ ID NO: 35 | CTAGGTCAAGTGTAGGAG | SCN1A | 97% |
| SEQ ID NO: 14 | EGR3 | SEQ ID NO: 36 | TAGGTACCATAGAGTGAG | SCN1A | 96% |
| SEQ ID NO: 15 | EGR3 | SEQ ID NO: 37 | TAGGTACCATAGAGTGAGGCGAGGATG | SCN1A | 97% |
| SEQ ID NO: 16 | EGR3 | SEQ ID NO: 38 | GAGTAGAAAAGAAACACA | GRN | 95% |

TABLE 5

Different types of zinc finger structures and proteins for generating eTFs

| ZF type name | | ZF structure (wherein each x can independently be any residue) | Exemplary proteins that can serve as the protein platform for an eTF or a DNA binding domain of an eTF disclosed herein |
|---|---|---|---|
| Zinc fingers C2H2-type (ZNF) | SEQ ID NO: 39 | C-x-C-x-H-x-H | KLF4, KLF5, EGR3, ZFP637, SLUG, ZNF750, ZNF281, ZBP89, GLIS1, GLIS3 |
| Ring finger proteins (RNF) | SEQ ID NO: 40 | C-x-C-x-C-x-H-xxx-C-x-C-x-C-x-C | MDM2, BRCA1, ZNF179 |
| PHD finger proteins (PHF) | SEQ ID NO: 41 | C-x-C-x-C-x-C-xxx-H-x-C-x-C-x-C | KDM2A, PHF1, ING1 |
| LEVI domain containing | SEQ ID NO: 42 | C-x-C-x-H-x-C-x-C-x-C-x-C-x-(C,H,D) | ZNF185, LIMK1, PXN |

TABLE 5-continued

Different types of zinc finger structures and proteins for generating eTFs

| ZF type name | ZF structure (wherein each x can independently be any residue) | | Exemplary proteins that can serve as the protein platform for an eTF or a DNA binding domain of an eTF disclosed herein |
|---|---|---|---|
| Nuclear hormone receptors (NR) | SEQ ID NO: 43 | C-x-C-x-C-xxx-C-x-C-x-C-x-C | VDR, ESR1, NR4A1 |
| Zinc fingers CCCH-type (ZC3H) | SEQ ID NO: 44 | C-x-C-x-C-x-H | RC3H1, HELZ, MBNL1, ZFP36, ZFP36L1 |
| Zinc fingers FYVE-type (ZFYVE) | SEQ ID NO: 43 | C-x-C-x-C-x-C-xxx-C-x-C-x-C-x-C | EEA1, HGS, PIKFYVE |
| Zinc fingers CCHC-type (ZCCHC) | SEQ ID NO: 45 | C-x-C-x-H-x-C | CNBP, SF1, LIN28A |
| Zinc fingers DHHC-type (ZDHHC) | SEQ ID NO: 46 | C-x-C-x-H-x-C-xxx-C-x-C-x-H-x-C | ZDHHC2, ZDHHC8, ZDHHC9 |
| Zinc fingers MYND-type (ZMYND) | SEQ ID NO: 47 | C-x-C-x-C-x-C-xxx-C-x-C-x-H-x-C | PDCD2, RUNX1T1, SMYD2, SMYD1 |
| Zinc fingers RANBP2-type (ZRANB) | SEQ ID NO: 48 | C-x-C-x-C-x-C | YAF2, SHARPIN, EWSR1 |
| Zinc fingers ZZ-type (ZZZ) | SEQ ID NO: 48 | C-x-C-x-C-x-C | HERC2, NBR1, CREBBP |
| Zinc fingers C2HC-type (ZC2HC) | SEQ ID NO: 45 | C-x-C-x-H-x-C | IKBKG, L3MBTL1, ZNF746 |
| GATA zinc-finger domain containing (GATAD) | SEQ ID NO: 48 | C-x-C-x-C-x-C | GATA4, GATA6, MTA1 |
| ZF class homeoboxes and pseudogenes | SEQ ID NO: 39 | C-x-C-x-H-x-H | ADNP, ZEB1, ZHX1 |
| THAP domain containing (THAP) | SEQ ID NO: 44 | C-x-C-x-C-x-H | THAP1, THAP4, THAP11 |
| Zinc fingers CXXC-type (MCC) | SEQ ID NO: 43 | C-x-C-x-C-x-C-xxx-C-x-C-x-C-x-C | CXXC1, CXXC5, MBD1, DNMT1 |
| Zinc fingers SWIM-type (ZSWIM) | SEQ ID NO: 44 | C-x-C-x-C-x-H | MAP3K1, ZSWIM5, ZSWIM6 |
| Zinc fingers AN1-type (ZFAND) | SEQ ID NO: 49 | C-x-C-x-C-x-C-xxx-C-x-H-x-H-x-C | ZFAND3, ZFAND6, IGHMBP2 |
| Zinc fingers 3CxxC-type (Z3CXXC) | SEQ ID NO: 45 | C-x-C-x-H-x-C | ZAR1, RTP1, RTP4 |
| Zinc fingers CW-type (ZCW) | SEQ ID NO: 48 | C-x-C-x-C-x-C | MORC1, ZCWPW1, KDM1B |
| Zinc fingers GRF-type (ZGRF) | SEQ ID NO: 48 | C-x-C-x-C-x-C | TTF2, NEIL3, TOP3A |
| Zinc fingers MIZ-type (ZMIZ) | SEQ ID NO: 45 | C-x-C-x-H-x-C | PIAS1, PIAS3, PIAS4 |
| Zinc fingers BED-type (ZBED) | SEQ ID NO: 39 | C-x-C-x-H-x-H | ZBED1, ZBED4, ZBED6 |
| Zinc fingers HIT-type (ZNHIT) | SEQ ID NO: 47 | C-x-C-x-C-x-C-xxx-C-x-C-x-H-x-C | ZNHIT3, DDX59, INO80B |
| Zinc fingers MYM-type (ZMYM) | SEQ ID NO: 48 | C-x-C-x-C-x-C | ZMYM2, ZMYM3, ZMYM4 |
| Zinc fingers matrin-type (ZMAT) | SEQ ID NO: 39 | C-x-C-x-H-x-H | ZNF638, ZMAT1, ZMAT3, ZMAT5 |
| Zinc fingers C2H2C-type | SEQ ID NO: 39 | C-x-C-x-H-x-H | MYT1, MYT1L, ST18 |

TABLE 5-continued

Different types of zinc finger structures and proteins for generating eTFs

| ZF type name | | ZF structure (wherein each x can independently be any residue) | Exemplary proteins that can serve as the protein platform for an eTF or a DNA binding domain of an eTF disclosed herein |
|---|---|---|---|
| Zinc fingers DBF-type (ZDBF) | SEQ ID NO: 39 | C-x-C-x-H-x-H | DBF4, DBF4B, ZDBF2 |
| Zinc fingers PARP-type | SEQ ID NO: 45 | C-x-C-x-H-x-C | LIG3, PARP1 |

TABLE 6

Examples of full-length amino acid sequences of eTFs

| | Amino Acid Sequence (N- to C-terminus) |
|---|---|
| SEQ ID NO: 50 | MAPKKKRKVGIHGVPAALEPGEKPYKCPECGKSFSRRDELNVHQRTHTGEKPYKCPECGKSFSSRRTC RAHQRTHTGEKPYKCPECGKSFSQSSNLVRHQRTHTGEKPYKCPECGKSFSQLAHLRAHQRTHTGEK PYKCPECGKSFSTSGNLVRHQRTHTGEKPYKCPECGKSFSHRTTLTNHQRTHTGKKTSKRPAATKKA GQAKKKKGSYPYDVPDYA |
| SEQ ID NO: 51 | MAPKKKRKVGIHGVPAALEPGEKPYKCPECGKSFSRRDELNVHQRTHTGEKPYKCPECGKSFSSRRTC RAHQRTHTGEKPYKCPECGKSFSQSSNLVRHQRTHTGEKPYKCPECGKSFSQLAHLRAHQRTHTGEK PYKCPECGKSFSTSGNLVRHQRTHTGEKPYKCPECGKSFSHRTTLTNHQRTHTGKKTSKRPAATKKA GQAKKKKGSYPYDVPDYALEDALDDFDLDMLGSDALDDFDLDMLGSDALDDFDLDMLGSDALDDF DLDML |
| SEQ ID NO: 52 | MAPKKKRKVGIHGVPAALEPGEKPYKCPECGKSFSRRDELNVHQRTHTGEKPYKCPECGKSFSSRRTC RAHQRTHTGEKPYKCPECGKSFSQSSNLVRHQRTHTGEKPYKCPECGKSFSQLAHLRAHQRTHTGEK PYKCPECGKSFSTSGNLVRHQRTHTGEKPYKCPECGKSFSHRTTLTNHQRTHTGKKTSKRPAATKKA GQAKKKKGSYPYDVPDYALEMSGLEMADHMMAMNHGRFPDGTNGLHHHPAHRMGMGQFPSPHH HQQQQPQHAFNALMGEHIHYGAGNMNATSGIRHAMGPGTVNGGHPPSALAPAARFNNSQFMGPPVA SQGGSLPASMQLQKLNNQYFNHHPYPHNHYMPDLHPAAGHQMNGTNQHFRDCNPKHSGGSSTPGGS GGSSTPGGSGSSSGGGAGSSNSGGGSGSGNMPASVAHVPAAMLPPNVIDTDFEDEEVLMSLVIEMGLD RIKELPELWLGQNEFDFMTDEVCKQQPSRVSC |
| SEQ ID NO: 53 | MAPKKKRKVGIHGVPAALEPGEKPYKCPECGKSFSRRDELNVHQRTHTGEKPYKCPECGKSFSSRRTC RAHQRTHTGEKPYKCPECGKSFSQSSNLVRHQRTHTGEKPYKCPECGKSFSQLAHLRAHQRTHTGEK PYKCPECGKSFSTSGNLVRHQRTHTGEKPYKCPECGKSFSHRTTLTNHQRTHTGKKTSKRPAATKKA GQAKKKKGSYPYDVPDYALEMADHLMLAEGYRLVQRPPSAAAAHGPHALRTLPPYAGPGLDSGLRP RGAPLGPPPPRQPGALAYGAFGPPSSFQPFFPAVPPPAAGIAHLQPVATPYPGRAAAPPNAPGGPPGPQP APSAAAPPPPAHALGGMDAELIDEEEALTSLELELGLHRVRELPELFLGQSEEDCFSDLGSAPPAGSVSC |
| SEQ ID NO: 54 | MAADHLMLAEGYRLVQRPPSAAAAHGPHALRTLPPYAGPGLDSGLRPRGAPLGPPPPRQPGALAYGA FGPPSSFQPFFPAVPPPAAGIAHLQPVATPYPGRAAAPPNAPGGPPGPQPAPSAAAPPPPAHALGGMDAE LIDEEEALTSLELELGLHRVRELPELFLGQSEEDCFSDLGSAPPAGSVSCGGSGGGGSGPKKKRKVGIHGV PAALEPGEKPYKCPECGKSFSRRDELNVHQRTHTGEKPYKCPECGKSFSSRRTCRAHQRTHTGEKPYK CPECGKSFSQSSNLVRHQRTHTGEKPYKCPECGKSFSQLAHLRAHQRTHTGEKPYKCPECGKSFSTSG NLVRHQRTHTGEKPYKCPECGKSFSHRTTLTNHQRTHTGKKTSKRPAATKKAGQAKKKKGSYPYDV PDYALEMADHLMLAEGYRLVQRPPSAAAAHGPHALRTLPPYAGPGLDSGLRPRGAPLGPPPPRQPGA LAYGAFGPPSSFQPFFPAVPPPAAGIAHLQPVATPYPGRAAAPPNAPGGPPGPQPAPSAAAPPPPAHALG GMDAELIDEEEALTSLELELGLHRVRELPELFLGQSEEDCFSDLGSAPPAGSVSC |
| SEQ ID NO: 55 | MQSQLIKPSRMRKYPNRPSKTPPHERPYACPVESCDRRFSRRDELNVHIRIHTGQKPFQCRICMRNFSS RRTCRAHIRTHTGEKPFACDICGRKFAQSSNLVRHTKIHLRQKDRPYACPVESCDRRFSQLAHLRAHIR IHTGQKPFQCRICMRNFSTSGNLVRHIRTHTGEKPFACDICGRKFAHRTTLTNHTKIHLRQKDKLEMSG LEMADHMMAMNHGRFPDTNGLHHHPAHRMGMGQFPSPHHHQQQQPQHAFNALMGEHIHYGAGN MNATSGIRHAMGPGTVNGGHPPSALAPAARFNNSQFMGPPVASQGGSLPASMQLQKLNNQYFNHEIP YPHNHYMPDLHPAAGHQMNGTNQHFRDCNPKHSGGSSTPGGSGGSSTPGGSGSSSGGGAGSSNSGG GSGSGNMPASVAHVPAAMLPPNVEDTDFEDEEVLMSLVIEMGLDRIKELPELWLGQNEFDFMTDEVCK QQPSRVSC |
| SEQ ID NO: 56 | MSGLEMADHMMAMNHGRFPDGTNGLHHHPAHRMGMGQFPSPHHHQQQQPQHAFNALMGEHIHYG AGNMNATSGVRHAMGPGTVNGGHPPSALAPAARFNNSQFMGPPVASQGGSLPASMQLQKLNNQYF NHHPYPHNHYMPDLHPAAGHQMNGTNQHFRDCNPKHSGGSSTPGGSGGSSTPGGSGSSSGGGAGSS NSGGGSGSGNMPASVAHVPAAMLPPNVIDTDFEDEEVLMSLVIEMGLDRIKELPELWLGQNEFDFMTD FVCKQQPSRVSCQSQLEKPSRMRKYPNRPSKTPPHERPYACPVESCDRRFSRRDELNVHIRIHTGQKPF QCRICMRNFSSRRTCRAHIRTHTGEKPFACDICGRKFAQSSNLVRHTKIHLRQKDRPYACPVESCDRRF SQLAHLRAHIRIHTGQKPFQCRICMRNFSTSGNLVRHIRTHTGEKPFACDICGRKFAHRTTLTNHTKIHL RQKDK |
| SEQ ID NO: 57 | MQSQLIKPSRMRKYPNRPSKTPPHERPYACPVESCDRRFSRSDNLVRHIRIHTGQKPFQCRICMRNFSR EDNLHTHIRTHTGEKPFACDICGRKFARSDELVRHTKIHLRQKDRPYACPVESCDRRFSQSGNLTEHIRI |

TABLE 6-continued

Examples of full-length amino acid sequences of eTFs

Amino Acid Sequence (N- to C-terminus)

| | |
|---|---|
| | HTGQKPFQCRICMRNFSTSGHLVRHIRTHTGEKPFACDICGRKFAQNSTLTEHTKIHLRQKDKLEMSGL<br>EMADHMMAMNHGRFPDGTNGLHHHPAHRMGMGQFPSPHHHQQQQPQHAFNALMGEHIHYGAGN<br>MNATSGIRHAMGPGTVNGGHPPSALAPAARFNNSQFMGPPVASQGGSLPASMQLQKLNNQYFNHEIP<br>YPHNHYMPDLHPAAGHQMNGTNQHFRDCNPKHSGGSSTPGGSGGSSTPGGSGSSSGGGAGSSNSGG<br>GSGSGNMPASVAHVPAAMLPPNVEDTDFEDEEVLMSLVIEMGLDRIKELPELWLGQNEFDFMTDFVCK<br>QQPSRVSC |
| SEQ ID<br>NO: 58 | MSGLEMADHMMAMNHGRFPDGTNGLHHHPAHRMGMGQFPSPHHHQQQQPQHAFNALMGEHIHYG<br>AGNMNATSGVRHAMGPGTVNGGHPPSALAPAARFNNSQFMGPPVASQGGSLPASMQLQKLNNQYF<br>NHHPYPHNHYMPDLHPAAGHQMNGTNQHFRDCNPKHSGGSSTPGGSGGSSTPGGSGSSSGGGAGSS<br>NSGGGSGSGNMPASVAHVPAAMLPPNVIDTDFEDEEVLMSLVIEMGLDRIKELPELWLGQNEFDFMTD<br>FVCKQQPSRVSCQSQLEKPSRMRKYPNRPSKTPPHERPYACPVESCDRRFSRSDNLVRHIRIHTGQKPF<br>QCRICMRNFSREDNLHTHIRTHTGEKPFACDICGRKFARSDELVRHTKIHLRQKDRPYACPVESCDRRF<br>SQSGNLTEHIRIHTGQKPFQCRICMRNFSTSGHLVRHIRTHTGEKPFACDICGRKFAQNSTLTEHTKIHL<br>RQKDK |
| SEQ ID<br>NO: 59 | MQSQLIKPSRMRKYPNRPSKTPPHERPYACPVESCDRRFSSPADLTRHIRIHTGQKPFQCRICMRNFSDS<br>GNLRVHIRTHTGEKPFACDICGRKFAQLAHLRAHTKIHLRQKDRPYACPVESCDRRFSQRANLRAHIRI<br>HTGQKPFQCRICMRNFSREDNLHTHIRTHTGEKPFACDICGRKFARSDNLVRHTKIHLRQKDKLEMSG<br>LEMADHMMAMNHGRFPDGTNGLHHHPAHRMGMGQFPSPHHHQQQQPQHAFNALMGEHIHYGAGN<br>MNATSGXRHAMGPGTVNGGHPPSALAPAARFNNSQFMGPPVASQGGSLPASMQLQKLNNQYFNHHP<br>YPHNHYMPDLHPAAGHQMNGTNQHFRDCNPKHSGGSSTPGGSGGSSTPGGSGSSSGGGAGSSNSGG<br>GSGSGNMPASVAHVPAAMLPPNVEDTDFEDEEVLMSLVIEMGLDRIKELPELWLGQNEFDFMTDFVCK<br>QQPSRVSC<br>(wherein X can be I or V) |
| SEQ ID<br>NO: 60 | MSGLEMADHMMAMNHGRFPDGTNGLHHHPAHRMGMGQFPSPHHHQQQQPQHAFNALMGEHIHYG<br>AGNMNATSGVRHAMGPGTVNGGHPPSALAPAARFNNSQFMGPPVASQGGSLPASMQLQKLNNQYF<br>NHHPYPHNHYMPDLHPAAGHQMNGTNQHFRDCNPKHSGGSSTPGGSGGSSTPGGSGSSSGGGAGSS<br>NSGGGSGSGNMPASVAHVPAAMLPPNVIDTDFEDEEVLMSLVIEMGLDRIKELPELWLGQNEFDFMTD<br>FVCKQQPSRVSCQSQLEKPSRMRKYPNRPSKTPPHERPYACPVESCDRRFSRRDELNVHIRIHTGQKPF<br>QCRICMRNFSSRRTCRAHIRTHTGEKPFACDICGRKFAQSSNLVRHTKIHLRQKDRPYACPVESCDRRF<br>SQLAHLRAHIRIHTGQKPFQCRICMRNFSTSGNLVRHIRTHTGEKPFACDICGRKFAHRTTLTNHTKIHL<br>RQKDK |
| SEQ ID<br>NO: 61 | MQSQLEKPSRMRKYPNRPSKTPPHERPYACPVESCDRRFSRSDNLVRHIRIHTGQKPFQCRICMRNFSR<br>EDNLHTHIRTHTGEKPFACDICGRKFARSDELVRHTKIHLRQKDRPYACPVESCDRRFSQSGNLTEHIRI<br>HTGQKPFQCRICMRNFSTSGHLVRHIRTHTGEKPFACDICGRKFAQNSTLTEHTKIHLRQKDKLEMAD<br>HLMLAEGYRLVQRPPSAAAAHGPHALRTLPPYAGPGLDSGLRPRGAPLGPPPPRQPGALAYGAFGPPS<br>SFQPFPAVPPPAAGIAHLQPVATPYPGRAAAPPNAPGGPPGQPAPSAAAPPPPAHALGGMDAELIDEE<br>ALTSLELELGLHRVRELPELFLGQSEFDCFSDLGSAPPAGSVSC |
| SEQ ID<br>NO: 62 | MAADHLMLAEGYRLVQRPPSAAAAHGPHALRTLPPYAGPGLDSGLRPRGAPLGPPPPRQPGALAYGA<br>FGPPSSFQPFPAVPPPAAGIAHLQPVATPYPGRAAAPPNAPGGPPGQPAPSAAAPPPPAHALGGMDAE<br>LIDEEALTSLELELGLHRVRELPELFLGQSEFDCFSDLGSAPPAGSVSCGGSGGGSGQSQLIKPSRMRKY<br>PNRPSKTPPHERPYACPVESCDRRFSRSDNLVRHIRIHTGQKPFQCRICMRNFSREDNLHTHIRTHTGEK<br>PFACDICGRKFARSDELVRHTKIHLRQKDRPYACPVESCDRRFSQSGNLTEHIRIHTGQKPFQCRICMR<br>NFSTSGHLVRHIRTHTGEKPFACDICGRKFAQNSTLTEHTKIHLRQKDKLEMADHLMLAEGYRLVQRP<br>PSAAAAHGPHALRTLPPYAGPGLDSGLRPRGAPLGPPPPRQPGALAYGAFGPPSSFQPFPAVPPPAAGI<br>AHLQPVATPYPGRAAAPPNAPGGPPGQPAPSAAAPPPPAHALGGMDAELIDEEALTSLELELGLHRV<br>RELPELFLGQSEFDCFSDLGSAPPAGSVSC |
| SEQ ID<br>NO: 63 | MQSQLIKPSRMRKYPNRPSKTPPHERPYACPVESCDRRFSSPADLTRHIRIHTGQKPFQCRICMRNFSDS<br>GNLRVHIRTHTGEKPFACDICGRKFAQLAHLRAHTKIHLRQKDRPYACPVESCDRRFSQRANLRAHIRI<br>HTGQKPFQCRICMRNFSREDNLHTHIRTHTGEKPFACDICGRKFARSDNLVRHTKIHLRQKDKLEMAD<br>HLMLAEGYRLVQRPPSAAAAHGPHALRTLPPYAGPGLDSGLRPRGAPLGPPPPRQPGALAYGAFGPPS<br>SFQPFPAVPPPAAGIAHLQPVATPYPGRAAAPPNAPGGPPGQPAPSAAAPPPPAHALGGMDAELIDEE<br>ALTSLELELGLHRVRELPELFLGQSEFDCFSDLGSAPPAGSVSC |
| SEQ ID<br>NO: 64 | MAADHLMLAEGYRLVQRPPSAAAAHGPHALRTLPPYAGPGLDSGLRPRGAPLGPPPPRQPGALAYGA<br>FGPPSSFQPFPAVPPPAAGIAHLQPVATPYPGRAAAPPNAPGGPPGQPAPSAAAPPPPAHALGGMDAE<br>LIDEEALTSLELELGLHRVRELPELFLGQSEEDCFSDLGSAPPAGSVSCGGSGGGSGQSQLIKPSRMRKY<br>PNRPSKTPPHERPYACPVESCDRRFSSPADLTRHIRIHTGQKPFQCRICMRNFSDSGNLRVHIRTHTGEK<br>PFACDICGRKFAQLAHLRAHTKIHLRQKDRPYACPVESCDRRFSQRANLRAHIRIHTGQKPFQCRICMR<br>NESREDNLHTHIRTHTGEKPFACDICGRKFARSDNLVRHTKIHLRQKDKLEMADHLMLAEGYRLVQR<br>PPSAAAAHGPHALRTLPPYAGPGLDSGLRPRGAPLGPPPPRQPGALAYGAFGPPSSFQPFPAVPPPAAGI<br>AHLQPVATPYPGRAAAPPNAPGGPPGQPAPSAAAPPPPAHALGGMDAELIDEEALTSLELELGLHRV<br>RELPELFLGQSEFDCFSDLGSAPPAGSVSC |
| SEQ ID<br>NO: 65 | MQSQLIKPSRMRKYPNRPSKTPPHERPYACPVESCDRRFSRRDELNVHIRIHTGQKPFQCRICMRNFSS<br>RRTCRAHIRTHTGEKPFACDICGRKFAQSSNLVRHTKIHLRQKDRPYACPVESCDRRFSQLAHLRAHIR<br>IHTGQKPFQCRICMRNFSTSGNLVRHIRTHTGEKPFACDICGRKFAHRTTLTNHTKIHLRQKDKLEMAD<br>HLMLAEGYRLVQRPPSAAAAHGPHALRTLPPYAGPGLDSGLRPRGAPLGPPPPRQPGALAYGAFGPPS<br>SFQPFPAVPPPAAGIAHLQPVATPYPGRAAAPPNAPGGPPGQPAPSAAAPPPPAHALGGMDAELIDEE<br>ALTSLELELGLHRVRELPELFLGQSEFDCFSDLGSAPPAGSVSC |

TABLE 6-continued

Examples of full-length amino acid sequences of eTFs

Amino Acid Sequence (N- to C-terminus)

SEQ ID NO: 66
MAADHLMLAEGYRLVQRPPSAAAAHGPHALRTLPPYAGPGLDSGLRPRGAPLGPPPPRQPGALAYGA
FGPPSSFQPFPAVPPPAAGIAHLQPVATPYPGRAAAPPNAPGGPPGPQPAPSAAAPPPPAHALGGMDAE
LIDEEALTSLELELGLHRVRELPELFLGQSEEDCFSDLGSAPPAGSVSCGGSGGGSGQSQLIKPSRMRKY
PNRPSKTPPHERPYACPVESCDRRFSRRDELNVHIRIHTGQKPFQCRICMRNFSSRRTCRAHIRTHTGEK
PFACDICGRKFAQSSNLVRHTKIHLRQKDRPYACPVESCDRRFSQLAHLRAHIRIHTGQKPFQCRICMR
NESTSGNLVRHIRTHTGEKPFACDICGRKFAHRTTLTNHTKIHLRQKDKLEMADHLMLAEGYRLVQRP
PSAAAAHGPHALRTLPPYAGPGLDSGLRPRGAPLGPPPPRQPGALAYGAFGPPSSFQPFPAVPPPAAGI
AHLQPVATPYPGRAAAPPNAPGGPPGPQPAPSAAAPPPPAHALGGMDAELIDEEALTSLELELGLHRV
RELPELFLGQSEFDCFSDLGSAPPAGSVSC

SEQ ID NO: 67
MAADHLMLAEGYRLVQRPPSAAAAHGPHALRTLPPYAGPGLDSGLRPRGAPLGPPPPRQPGALAYGA
FGPPSSFQPFPAVPPPAAGIAHLQPVATPYPGRAAAPPNAPGGPPGPQPAPSAAAPPPPAHALGGMDAE
LIDEEALTSLELELGLHRVRELPELFLGQSEEDCFSDLGSAPPAGSVSCGGSGGGSGQSQLIKPSRMRKY
PNRPSKTPPHERPYACPVESCDRRFSRSDNLVRHIRIHTGQKPFQCRICMRNFSHRTTLTNHIRTHTGEK
PFACDICGRKFAREDNLHTHTKIHLRQKDRPYACPVESCDRRFSTSHSLTEHIRIHTGQKPFQCRICMRN
FSQSSSLVRHIRTHTGEKPFACDICGRKFAREDNLHTHTKIHLRQKDKLEMADHLMLAEGYRLVQRPP
SAAAAHGPHALRTLPPYAGPGLDSGLRPRGAPLGPPPPRQPGALAYGAFGPPSSFQPFPAVPPPAAGIA
HLQPVATPYPGRAAAPPNAPGGPPGPQPAPSAAAPPPPAHALGGMDAELIDEEALTSLELELGLHRVR
ELPELFLGQSEFDCFSDLGSAPPAGSVSC

SEQ ID NO: 68
MAADHLMLAEGYRLVQRPPSAAAAHGPHALRTLPPYAGPGLDSGLRPRGAPLGPPPPRQPGALAYGA
FGPPSSFQPFPAVPPPAAGIAHLQPVATPYPGRAAAPPNAPGGPPGPQPAPSAAAPPPPAHALGGMDAE
LIDEEALTSLELELGLHRVRELPELFLGQSEEDCFSDLGSAPPAGSVSCGGSGGGSGQSQLIKPSRMRKY
PNRPSKTPPHERPYACPVESCDRRFSRSDNLVRHIRIHTGQKPFQCRICMRNFSHRTTLTNHIRTHTGEK
PFACDICGRKFAREDNLHTHTKIHLRQKDRPYACPVESCDRRFSTSHSLTEHIRIHTGQKPFQCRICMRN
FSQSSSLVRHIRTHTGEKPFACDICGRKFAREDNLHTHTKIHLRQKDK

SEQ ID NO: 69
MAADHLMLAEGYRLVQRPPSAAAAHGPHALRTLPPYAGPGLDSGLRPRGAPLGPPPPRQPGALAYGA
FGPPSSFQPFPAVPPPAAGIAHLQPVATPYPGRAAAPPNAPGGPPGPQPAPSAAAPPPPAHALGGMDAE
LIDEEALTSLELELGLHRVRELPELFLGQSEEDCFSDLGSAPPAGSVSCGGSGGGSGQSQLIKPSRMRKY
PNRPSKTPPHERPYACPVESCDRRFSRSDNLVRHIRIHTGQKPFQCRICMRNFSREDNLHTHIRTHTGEK
PFACDICGRKFARSDELVRHTKIHLRQKDRPYACPVESCDRRFSQSGNLTEHIRIHTGQKPFQCRICMR
NESTSGHLVRHIRTHTGEKPFACDICGRKFAQNSTLTEHTKIHLRQKDK

SEQ ID NO: 70
MRPHACPAEGCDRRFSRSDNLVRHLRIHTGHKPFQCRICMRSFSREDNLHTHIRTHTGEKPFACEFCGR
KFARSDELVRHAKIHLKQKEHACPAEGCDRRFSQSGNLTEHRIHTGHKPFQCRICMRSFSTSGHLVR
HIRTHTGEKPFACEFCGRKFAQNSTLTEHAKIHLKQKEKKAEKGGAPSASSAPPVSLAPVVTTCALEM
SGLEMADHMMAMNHGRFPDGTNGLHHHPAHRMGMGQPSPHHHQQQQPQHAFNALMGEHIHYGA
GNMNATSGIRHAMGPGTVNGGHPPSALAPAARFNNSQFMGPPVASQGGSLPASMQLQKLNNQYFNH
HPYPHNHYMPDLHPAAGHQMNGTNQHFRDCNPKHSGGSSTPGGSGGSSTPGGSGSSSGGGAGSSNSG
GGSGSGNMPASVAHVPAAMLPPNVIDTDFEDEEVLMSLVIEMGLDRIKELPELWLGQNEFDFMTDEVC
KQQPSRVSC

SEQ ID NO: 71
MSGLEMADHMMAMNHGRFPDGTNGLHHHPAHRMGMGQFPSPHHHQQQQPQHAFNALMGEHIHYG
AGNMNATSGVRHAMGPGTVNGGHPPSALAPAARFNNSQFMGPPVASQGGSLPASMQLQKLNNQYF
NHHPYPHNHYMPDLHPAAGHQMNGTNQHFRDCNPKHSGGSSTPGGSGGSSTPGGSGSSSGGGAGSS
NSGGGSGSGNMPASVAHVPAAMLPPNVIDTDFEDEEVLMSLVIEMGLDRIKELPELWLGQNEFDFMTD
FVCKQQPSRVSCRPHACPAEGCDRRFSRSDNLVRHLRIHTGHKPFQCRICMRSFSREDNLHTHIRTHTG
EKPFACEFCGRKFARSDELVRHAKIHLKQKEHACPAEGCDRRFSQSGNLTEHLRIHTGHKPFQCRICM
RSFSTSGHLVRHIRTHTGEKPFACEFCGRKFAQNSTLTEHAKIHLKQKEKKAEKGGAPSASSAPPVSLA
PVVTTCA

SEQ ID NO: 72
MRPHACPAEGCDRRFSSPADLTRHLRIHTGHKPFQCRICMRSFSDSGNLRVHIRTHTGEKPFACEFCGR
KFAQLAHLRAHAKIHLKQKEHACPAEGCDRRFSQRANLRAHLRIHTGHKPFQCRICMRSFSREDNLHT
HIRTHTGEKPFACEFCGRKFARSDNLVRHAKIHLKQKEKKAEKGGAPSASSAPPVSLAPVVTTCALEM
SGLEMADHMMAMNHGRFPDGTNGLHHHPAHRMGMGQFPSPHHHQQQQPQHAFNALMGEHIHYGA
GNMNATSGXRHAMGPGTVNGGHPPSALAPAARFNNSQFMGPPVASQGGSLPASMQLQKLNNQYFN
HHPYPHNHYMPDLHPAAGHQMNGTNQHFRDCNPKHSGGSSTPGGSGGSSTPGGSGSSSGGGAGSSNS
GGGSGSGNMPASVAHVPAAMLPPNVEDTDFIDEEVLMSLVIEMGLDREKELPELWLGQNEFDFMTDFV
CKQQPSRVSC
(wherein X can be I or V)

SEQ ID NO: 73
MSGLEMADHMMAMNHGRFPDGTNGLHHHPAHRMGMGQFPSPHHHQQQQPQHAFNALMGEHIHYG
AGNMNATSGVRHAMGPGTVNGGHPPSALAPAARFNNSQFMGPPVASQGGSLPASMQLQKLNNQYF
NHHPYPHNHYMPDLHPAAGHQMNGTNQHFRDCNPKHSGGSSTPGGSGGSSTPGGSGSSSGGGAGSS
NSGGGSGSGNMPASVAHVPAAMLPPNVIDTDFEDEEVLMSLVIEMGLDRIKELPELWLGQNEFDFMTD
FVCKQQPSRVSCRPHACPAEGCDRRFSSPADLTRHLRIHTGHKPFQCRICMRSFSDSGNLRVHIRTHTG
EKPFACEFCGRKFAQLAHLRAHAKIHLKQKEHACPAEGCDRRFSQRANLRAHLRIHTGHKPFQCRICM
RSFSREDNLHTHIRTHTGEKPFACEFCGRKFARSDNLVRHAKIHLKQKEKKAEKGGAPSASSAPPVSL
APVVTTCA

SEQ ID NO: 74
MRPHACPAEGCDRRFSRSDNLVRHLRIHTGHKPFQCRICMRSFSREDNLHTHIRTHTGEKPFACEFCGR
KFARSDELVRHAKIHLKQKEHACPAEGCDRRFSQSGNLTEHLRIHTGHKPFQCRICMRSFSTSGHLVR
HIRTHTGEKPFACEFCGRKFAQNSTLTEHAKIHLKQKEKLEMADHLMLAEGYRLVQRPPSAAAAHGP

TABLE 6-continued

Examples of full-length amino acid sequences of eTFs

Amino Acid Sequence (N- to C-terminus)

|  |  |
|---|---|
|  | HALRTLPPYAGPGLDSGLRPRGAPLGPPPPRQPGALAYGAFGPPSSFQPFPAVPPPAAGIAHLQPVATP YPGRAAAPPNAPGGPPGPQPAPSAAAPPPPAHALGGMDAELIDEEALTSLELELGLHRVRELPELFLGQ SEFDCFSDLGSAPPAGSVSC |
| SEQ ID NO: 75 | MAADHLMLAEGYRLVQRPPSAAAAHGPHALRTLPPYAGPGLDSGLRPRGAPLGPPPPRQPGALAYGA FGPPSSFQPFPAVPPPAAGIAHLQPVATPYPGRAAAPPNAPGGPPGPQPAPSAAAPPPPAHALGGMDAE LIDEEALTSLELELGLHRVRELPELFLGQSEFDCFSDLGSAPPAGSVSCGGSGGGSGRPHACPAEGCDR RFSRSDNLVRHLRIHTGHKPFQCRICMRSFSREDNLHTHIRTHTGEKPFACEFCGRKFARSDELVRHAK HELKQKEHACPAEGCDRRFSQSGNLTEHLRIHTGHKPFQCRICMRSFSTSGHLVRHIRTHTGEKPFACE FCGRKFAQNSTLTEHAKIHLKQKEKLEMADHLMLAEGYRLVQRPPSAAAAHGPHALRTLPPYAGPGL DSGLRPRGAPLGPPPPRQPGALAYGAFGPPSSFQPFPAVPPPAAGIAHLQPVATPYPGRAAAPPNAPGG PPGPQPAPSAAAPPPPAHALGGMDAELEDEEALTSLELELGLHRVRELPELFLGQSEFDCFSDLGSAPPA GSVSC |
| SEQ ID NO: 76 | MRPHACPAEGCDRRFSSPADLTRHLRIHTGHKPFQCRICMRSFSDSGNLRVHIRTHTGEKPFACEFCGR KFAQLAHLRAHAKIHLKQKEHACPAEGCDRRFSQRANLRAHLRIHTGHKPFQCRICMRSFSREDNLHT HIRTHTGEKPFACEFCGRKFARSDNLVRHAKIHLKQKEKLEMADHLMLAEGYRLVQRPPSAAAAHGP HALRTLPPYAGPGLDSGLRPRGAPLGPPPPRQPGALAYGAFGPPSSFQPFPAVPPPAAGIAHLQPVATP YPGRAAAPPNAPGGPPGPQPAPSAAAPPPPAHALGGMDAELIDEEALTSLELELGLHRVRELPELFLGQ SEFDCFSDLGSAPPAGSVSC |
| SEQ ID NO: 77 | MAADHLMLAEGYRLVQRPPSAAAAHGPHALRTLPPYAGPGLDSGLRPRGAPLGPPPPRQPGALAYGA FGPPSSFQPFPAVPPPAAGIAHLQPVATPYPGRAAAPPNAPGGPPGPQPAPSAAAPPPPAHALGGMDAE LIDEEALTSLELELGLHRVRELPELFLGQSEFDCFSDLGSAPPAGSVSCGGSGGGSGRPHACPAEGCDR RFSSPADLTRHLRIHTGHKPFQCRICMRSFSDSGNLRVHIRTHTGEKPFACEFCGRKFAQLAHLRAHAK HELKQKEHACPAEGCDRRFSQRANLRAHLRIHTGHKPFQCRICMRSFSREDNLHTHIRTHTGEKPFACE FCGRKFARSDNLVRHAKIHLKQKEKLEMADHLMLAEGYRLVQRPPSAAAAHGPHALRTLPPYAGPG LDSGLRPRGAPLGPPPPRQPGALAYGAFGPPSSFQPFPAVPPPAAGIAHLQPVATPYPGRAAAPPNAPG GPPGPQPAPSAAAPPPPAHALGGMDAELEDEEALTSLELELGLHRVRELPELFLGQSEFDCFSDLGSAPP AGSVSC |
| SEQ ID NO: 78 | MRPHACPAEGCDRRFSRRDELNVHLRIHTGHKPFQCRICMRSFSSRRTCRAHIRTHTGEKPFACEFCGR KFAQSSNLVRHAKIHLKQKEHACPAEGCDRRFSQLAHLRAHLRIHTGHKPFQCRICMRSFSTSGNLVR HIRTHTGEKPFACEFCGRKFAHRTTLTNHAKIHLKQKEKLEMSGLEMADHMMAMNHGRFPDGTNGL HHHPAHRMGMGQFPSPHHHQQQQPQHAFNALMGEHIHYGAGNMNATSGIRHAMGPGTVNGGHPPS ALAPAARFNNSQFMGPPVASQGGSLPASMQLQKLNNQYFNHHPYPHNHYMPDLHPAAGHQMNGTN QHFRDCNPKHSGGSSTPGGSGGSSTPGGSGSSSGGGAGSSNSGGGSGSGNMPASVAHVPAAMLPPNVI DTDFIDEEVLMSLVIEMGLDRIKELPELWLGQNEFDFMTDFVCKQQPSRVSC |
| SEQ ID NO: 79 | MAADHLMLAEGYRLVQRPPSAAAAHGPHALRTLPPYAGPGLDSGLRPRGAPLGPPPPRQPGALAYGA FGPPSSFQPFPAVPPPAAGIAHLQPVATPYPGRAAAPPNAPGGPPGPQPAPSAAAPPPPAHALGGMDAE LIDEEALTSLELELGLHRVRELPELFLGQSEFDCFSDLGSAPPAGSVSCGGSGGGSGRPHACPAEGCDR RFSRRDELNVHLRIHTGHKPFQCRICMRSFSSRRTCRAHIRTHTGEKPFACEFCGRKFAQSSNLVRHAK IHLKQKEHACPAEGCDRRFSQLAHLRAHLRIHTGHKPFQCRICMRSFSTSGNLVRHIRTHTGEKPFACE FCGRKFAHRTTLTNHAKIHLKQKEKLEMADHLMLAEGYRLVQRPPSAAAAHGPHALRTLPPYAGPGL DSGLRPRGAPLGPPPPRQPGALAYGAFGPPSSFQPFPAVPPPAAGIAHLQPVATPYPGRAAAPPNAPGG PPGPQPAPSAAAPPPPAHALGGMDAELIDEEALTSLELELGLHRVRELPELFLGQSEFDCFSDLGSAPPA GSVSC |
| SEQ ID NO: 80 | MRPHACPAEGCDRRFSRRDELNVHLRIHTGHKPFQCRICMRSFSSRRTCRAHIRTHTGEKPFACEFCGR KFAQSSNLVRHAKIHLKQKEHACPAEGCDRRFSQLAHLRAHLRIHTGHKPFQCRICMRSFSTSGNLVR HIRTHTGEKPFACEFCGRKFAHRTTLTNHAKIHLKQKEKLEMADHLMLAEGYRLVQRPPSAAAAHGP HALRTLPPYAGPGLDSGLRPRGAPLGPPPPRQPGALAYGAFGPPSSFQPFPAVPPPAAGIAHLQPVATP YPGRAAAPPNAPGGPPGPQPAPSAAAPPPPAHALGGMDAELIDEEALTSLELELGLHRVRELPELFLGQ SEFDCFSDLGSAPPAGSVSC |
| SEQ ID NO: 268 | MAPKKKRKVGIHGVPAALEPGEKPYKCPECGKSFSDPGHLVRHQRTHTGEKPYKCPECGKSFSTKNS LTEHQRTHTGEKPYKCPECGKSFSRNDALTEHQRTHTGEKPYKCPECGKSFSERSHLREHQRTHTGEK PYKCPECGKSFSSKKHLAEHQRTHTGEKPYKCPECGKSFSTHLDLIRHQRTHTGEKPYKCPECGKSFSQ SGNLTEHQRTHTGKKTSKRPAATKKAG |
| SEQ ID NO: 269 | MAPKKKRKVGIHGVPAALEPGEKPYKCPECGKSFSSRRTCRAHQRTHTGEKPYKCPECGKSFSTTGAL TEHQRTHTGEKPYKCPECGKSFSRSDELVRHQRTHTGEKPYKCPECGKSFSRNDALTEHQRTHTGEKP YKCPECGKSFSQSGDLRRHQRTHTGEKPYKCPECGKSFSTSHSLTEHQRTHTGKKTSKRPAATKKAG |
| SEQ ID NO: 270 | MAPKKKRKVGIHGVPAALEPGEKPYKCPECGKSFSRKDNLKNHQRTHTGEKPYKCPECGKSFSDPGA LVRHQRTHTGEKPYKCPECGKSFSREDNLHTHQRTHTGEKPYKCPECGKSFSDPGALVRHQRTHTGE KPYKCPECGKSFSTSGELVRHQRTHTGEKPYKCPECGKSFSRKDNLKNHQRTHTGKKTSKRPAATKK AG |
| SEQ ID NO: 271 | MAPKKKRKVGIHGVPAALEPGEKPYKCPECGKSFSRSDNLVRHQRTHTGEKPYKCPECKSFSREDN LHTHQRTHTGEKPYKCPECGKSFSRSDELVRHQRTHTGEKPYKCPECGKSFSQSGNLTEHQRTHTGEK PYKCPECGKSFSTSGHLVRHQRTHTGEKPYKCPECGKSFSQNSTLTEHQRTHTGKKTSKRPAATKKAG QAKKKKGSYPYDVPDYALEDALDDFDLDMLGSDALDDFDLDMLGSDALDDFDLDMLGSDALDDFD LDML |

TABLE 6-continued

Examples of full-length amino acid sequences of eTFs

Amino Acid Sequence (N- to C-terminus)

| | |
|---|---|
| SEQ ID NO: 272 | MAPKKKRKVGIHGVPAALEPGEKPYKCPECGKSFSSKKALTEHQRTHTGEKPYKCPECGKSFSSPADL TRHQRTHTGEKPYKCPECGKSFSRSDNLVRHQRTHTGEKPYKCPECGKSFSREDNLHTHQRTHTGEKP YKCPECGKSFSRSDELVRHQRTHTGEKPYKCPECGKSFSQSGNLTEHQRTHTGEKPYKCPECGKSFST SGHLVRHQRTHTGEKPYKCPECGKSFSQNSTLTEHQRTHTGKKTSKRPAATKKAGQAKKKKGSYPY DVPDYALEDALDDFDLDMLGSDALDDFDLDMLGSDALDDFDLDMLGSDALDDFDLDML |
| SEQ ID NO: 273 | MAPKKKRKVGIHGVPAALEPGEKPYKCPECGKSFSSPADLTRHQRTHTGEKPYKCPEGKSFSRSDNL VRHQRTHTGEKPYKCPECGKSFSREDNLHTHQRTHTGEKPYKCPECGKSFSRSDELVRHQRTHTGEKP YKCPECGKSFSQSGNLTEHQRTHTGEKPYKCPECGKSFSTSGHLVRHQRTHTGKKTSKRPAATKKAG |
| SEQ ID NO: 274 | MAPKKKRKVGIHGVPAALEPGEKPYKCPECGKSFSSKKALTEHQRTHTGEKPYKCPECGKSFSSPADL TRHQRTHTGEKPYKCPECGKSFSRSDNLVRHQRTHTGEKPYKCPECGKSFSREDNLHTHQRTHTGEKP YKCPECGKSFSRSDELVRHQRTHTGEKPYKCPECGKSFSQSGNLTEHQRTHTGKKTSKRPAATKKAG |
| SEQ ID NO: 275 | MAPKKKRKVGIHGVPAALEPGEKPYKCPECGKSFSDCRDLARHQRTHTGEKPYKCPECGKSFSRNDA LTEHQRTHTGEKPYKCPECGKSFSRNDALEHQRTHTGEKPYKCPECGKSFSSPADLTRHQRTHTGEK PYKCPECGKSFSDPGNLVRHQRTHTGEKPYKCPECGKSFSQRAHLERHQRTHTGEKPYKCPECGKSFS QSSSLVRHQRTHTGEKPYKCPECGKSFSHRTTLTNHQRTHTGKKTSKRPAATKKAG |
| SEQ ID NO: 276 | MAPKKKRKVGIHGVPAALEPGEKPYKCPECGKSFSRNDALTEHQRTHTGEKPYKCPEGKSFSSPADL TRHQRTHTGEKPYKCPECGKSFSDPGNLVRHQRTHTGEKPYKCPECGKSFSQRAHLERHQRTHTGEK PYKCPECGKSFSQSSLVRHQRTHTGEKPYKCPECGKSFSHRTTLTNHQRTHTGKKTSKRPAATKKAG |
| SEQ ID NO: 277 | MAPKKKRKVGIHGVPAALEPGEKPYKCPECGKSFSTKNSLTEHQRTHTGEKPYKCPECGKSFSRADNL TEHQRTHTGEKPYKCPECGKSFSQLAHLRAHQRTHTGEKPYKCPECGKSFSTKNSLTEHQRTHTGEKP YKCPECGKSFSQAGHLASHQRTHTGEKPYKCPECGKSFSTHLDLIRHQRTHTGKKTSKRPAATKKAG |
| SEQ ID NO: 278 | MAPKKKRKVGIHGVPAALEPGEKPYKCPECGKSFSRNDALTEHQRTHTGEKPYKCPECGKSFSDPGH LVRHQRTHTGEKPYKCPECGKSFSTSGELVRHQRTHTGEKPYKCPECGKSFSTHLDLIRHQRTHTGEK PYKCPECGKSFSSKKALTEHQRTHTGEKPYKCPECGKSFSQLAHLRAHQRTHTGEKPYKCPECGKSFS RSDHLTNHQRTHTGKKTSKRPAATKKAG |
| SEQ ID NO: 279 | MAPKKKRKVGIHGVPAALEPGEKPYKCPECGKSFSRSDNLVRHQRTHTGEKPYKCPECGKSFSHRTTL TNHQRTHTGEKPYKCPECGKSFSREDNLHTHQRTHTGEKPYKCPECGKSFSTSHSLTEHQRTHTGEKP YKCPECGKSFSQSSLVRHQRTHTGEKPYKCPECGKSFSREDNLHTHQRTHTGKKTSKRPAATKKAG QAKKKGSYPYDVPDYALEDALDDFDLDMLGSDALDDFDLDMLGSDALDDFDLDMLGSDALDDFD LDML |
| SEQ ID NO: 280 | MAPKKKRKVGIHGVPAALEPGEKPYKCPECGKSFSDPGALVRHQRTHTGEKPYKCPECGKSFSRSDN LVRHQRTHTGEKPYKCPECGKSFSQSGDLRRHQRTHTGEKPYKCPECGKSFSTHLDLIRHQRTHTGEK PYKCPECGKSFSTSGNLVRHQRTHTGEKPYKCPECGKSFSRSDNLVRHQRTHTGKKTSKRPAATKKA GQAKKKKGSYPYDVPDYALEDALDDFDLDMLGSDALDDFDLDMLGSDALDDFDLDMLGSDALDDF DLDML |
| SEQ ID NO: 281 | MAPKKKRKVGIHGVPAALEPGEKPYKCPECGKSFSQAGHLASHQRTHTGEKPYKCPECGKSFSREDN LHTHQRTHTGEKPYKCPECGKSFSTSGNLTEHQRTHTGEKPYKCPECGKSFSTHLDLIRHQRTHTGEK PYKCPECGKSFSQKSSLIAHQRTHTGEKPYKCPECGKSFSQAGHLASHQRTHTGKKTSKRPAATKKAG |
| SEQ ID NO: 282 | MAPKKKRKVGIHGVPAALEPGEKPYKCPECGKSFSTTGNLTVHQRTHTGEKPYKCPECGKSFSTSGEL VRHQRTHTGEKPYKCPECGKSFSREDNLHTHQRTHTGEKPYKCPECGKSFSTSGNLTEHQRTHTGEKP YKCPECGKSFSQSSSLVRHQRTHTGEKPYKCPECGKSFSQRANLRAHQRTHTGKKTSKRPAATKKAG |

TABLE 7

DBD sequences of eTFs disclosed in TABLE 6

| eTF SEQ ID NO: | DBD SEQ ID NO: | DBD sequence | Protein Platform for DBD | NCBI-BLAST Sequence Identity Between DBD and Protein Platform |
|---|---|---|---|---|
| SEQ ID NO: 50 | SEQ ID NO: 81 | LEPGEKPYKCPECGKSFSRRDELNVHQRTHTGEKPYKCPECGK SFSSRRTCRAHQRTHTGEKPYKCPECGKSFSQSSNLVRHQRTH TGEKPYKCPECGKSFSQLAHLRAHQRTHTGEKPYKCPECGKSF STSGNLVRHQRTHTGEKPYKCPECGKSFSHRTTLTNHQRTHTG KKTS | Synthetic | 67% |
| SEQ ID NO: 51 | SEQ ID NO: 81 | (same as above) | Synthetic | 67% |

TABLE 7-continued

DBD sequences of eTFs disclosed in TABLE 6

| eTF SEQ ID NO: | DBD SEQ ID NO: | DBD sequence | Protein Platform for DBD | NCBI-BLAST Sequence Identity Between DBD and Protein Platform |
|---|---|---|---|---|
| SEQ ID NO: 52 | SEQ ID NO: 81 | (same as above) | Synthetic | 67% |
| SEQ ID NO: 53 | SEQ ID NO: 81 | (same as above) | Synthetic | 67% |
| SEQ ID NO: 54 | SEQ ID NO: 81 | (same as above) | Synthetic | 67% |
| SEQ ID NO: 55 | SEQ ID NO: 82 | MQSQLIKPSRMRKYPNRPSKTPPHERPYACPVESCDRRFSRRD ELNVHIRIHTGQKPFQCRICMRNFSSRRTCRAHIRTHTGEKPFA CDICGRKFAQSSNLVRHTKIHLRQKDRPYACPVESCDRRFSQL AHLRAHIRIHTGQKPFQCRICMRNFSTSGNLVRHIRTHTGEKPF ACDICGRKFAHRTTLTNHTKIHLRQKDK | EGR1 | 86% |
| SEQ ID NO: 56 | SEQ ID NO: 83 | QSQLIKPSRMRKYPNRPSKTPPHERPYACPVESCDRRFSRRDEL NVHIRIHTGQKPFQCRICMRNFSSRRTCRAHIRTHTGEKPFACD ICGRKFAQSSNLVRHTKIHLRQKDRPYACPVESCDRRFSQLAH LRAHIRIHTGQKPFQCRICMRNFSTSGNLVRHIRTHTGEKPFAC DICGRKFAHRTTLTNHTKIHLRQKDK | EGR1 | 86% |
| SEQ ID NO: 57 | SEQ ID NO: 84 | RPYACPVESCDRRFSRSDNLVRHIRIHTGQKPFQCRICMRNFSR EDNLHTHIRTHTGEKPFACDICGRKFARSDELVRHTKIHLRQK DRPYACPVESCDRRFSQSGNLTEHIRIHTGQKPFQCRICMRNFS TSGHLVRHIRTHTGEKPFACDICGRKFAQNSTLTEHTKIHLRQK D | EGR1 | 93% |
| SEQ ID NO: 58 | SEQ ID NO: 85 | QSQLIKPSRMRKYPNRPSKTPPHERPYACPVESCDRRFSRSDNL VRHIRIHTGQKPFQCRICMRNFSREDNLHTHIRTHTGEKPFACD ICGRKFARSDELVRHTKIHLRQKDRPYACPVESCDRRFSQSGN LTEHIRIHTGQKPFQCRICMRNFSTSGHLVRHIRTHTGEKPFAC DICGRKFAQNSTLTEHTKIHLRQKDK | EGR1 | 93% |
| SEQ ID NO: 59 | SEQ ID NO: 86 | MQSQLIKPSRMRKYPNRPSKTPPHERPYACPVESCDRRFSSPA DLTRHIRIHTGQKPFQCRICMRNFSDSGNLRVHIRTHTGEKPFA CDICGRKFAQLAHLRAHTKIHLRQKDRPYACPVESCDRRFSQR ANLRAHIRIHTGQKPFQCRICMRNFSREDNLHTHIRTHTGEKPF ACDICGRKFARSDNLVRHTKIHLRQKDK | EGR1 | 84% |
| SEQ ID NO: 60 | SEQ ID NO: 87 | RPYACPVESCDRRFSRRDELNVHIRIHTGQKPFQCRICMRNFSS RRTCRAHIRTHTGEKPFACDICGRKFAQSSNLVRHTKIHLRQK DRPYACPVESCDRRFSQLAHLRAHIRIHTGQKPFQCRICMRNFS TSGNLVRHIRTHTGEKPFACDICGRKFAHRTTLTNHTKIHLRQ KDK* | EGR1 | 84% |
| SEQ ID NO: 61 | SEQ ID NO: 88 | RPYACPVESCDRRFSRSDNLVRHIRIHTGQKPFQCRICMRNFSR EDNLHTHIRTHTGEKPFACDICGRKFARSDELVRHTKIHLRQK DRPYACPVESCDRRFSQSGNLTEHIRIHTGQKPFQCRICMRNFS TSGHLVRHIRTHTGEKPFACDICGRKFAQNSTLTEHTKIHLRQK DK | EGR1 | 93% |
| SEQ ID NO: 62 | SEQ ID NO: 88 | (same as above) | EGR1 | 93% |
| SEQ ID NO: 63 | SEQ ID NO: 89 | RPYACPVESCDRRFSSPADLTRHIRIHTGQKPFQCRICMRNFSD SGNLRVHIRTHTGEKPFACDICGRKFAQLAHLRAHTKIHLRQK DRPYACPVESCDRRFSQRANLRAHIRIHTGQKPFQCRICMRNFS REDNLHTHIRTHTGEKPFACDICGRKFARSDNLVRHTKIHLRQ KDK | EGR1 | 84% |
| SEQ ID NO: 64 | SEQ ID NO: 89 | (same as above) | EGR1 | 84% |
| SEQ ID NO: 65 | SEQ ID NO: 82 | (same as above) | EGR1 | 86% |
| SEQ ID NO: 66 | SEQ ID NO: 82 | (same as above) | EGR1 | 86% |

TABLE 7-continued

DBD sequences of eTFs disclosed in TABLE 6

| eTF SEQ ID NO: | DBD SEQ ID NO: | DBD sequence | Protein Platform for DBD | NCBI-BLAST Sequence Identity Between DBD and Protein Platform |
|---|---|---|---|---|
| SEQ ID NO: 67 | SEQ ID NO: 90 | QSQLIKPSRMRKYPNRPSKTPPHERPYACPVESCDRRFSRSDNLVRHIRIHTGQKPFQCRICMRNFSHRTTLTNHIRTHTGEKPFACDICGRKFAREDNLHTHTKIHLRQKDRPYACPVESCDRRFSTSHSLTEHIRIHTGQKPFQCRICMRNFSQSSSLVRHIRTHTGEKPFACDICGRKFAREDNLHTHTKIHLRQKDK | EGR1 | 79% |
| SEQ ID NO: 68 | SEQ ID NO: 90 | (same as above) | EGR1 | 79% |
| SEQ ID NO: 69 | SEQ ID NO: 91 | QSQLIKPSRMRKYPNRPSKTPPHERPYACPVESCDRRFSRSDNLVRHIRIHTGQKPFQCRICMRNFSREDNLHTHIRTHTGEKPFACDICGRKFARSDELVRHTKIHLRQKDRPYACPVESCDRRFSQSGNLTEHIRIHTGQKPFQCRICMRNFSTSGHLVRHIRTHTGEKPFACDICGRKFAQNSTLTEHTKIHLRQKDK | EGR1 | 81% |
| SEQ ID NO: 70 | SEQ ID NO: 92 | HACPAEGCDRRFSRSDNLVRHLRIHTGHKPFQCRICMRSFSREDNLHTHIRTHTGEKPFACEFCGRKFARSDELVRHAKIHLKQKEHACPAEGCDRRFSQSGNLTEHLRIHTGHKPFQCRICMRSFSTSGHLVRHIRTHTGEKPFACEFCGRKFAQNSTLTEHAKIHLKQKE | EGR3 | 92% |
| SEQ ID NO. 71 | SEQ ID NO. 92 | (same as above) | EGR3 | 92% |
| SEQ ID NO: 72 | SEQ ID NO: 93 | HACPAEGCDRRFSSPADLTRHLRIHTGHKPFQCRICMRSFSDSGNLRVHIRTHTGEKPFACEFCGRKFAQLAHLRAHAKIHLKQKEHACPAEGCDRRFSQRANLRAHLRIHTGHKPFQCRICMRSFSREDNLHTHIRTHTGEKPFACEFCGRKFARSDNLVRHAKIHLKQKE | EGR3 | 80% |
| SEQ ID NO: 73 | SEQ ID NO: 93 | (same as above) | EGR3 | 80% |
| SEQ ID NO: 74 | SEQ ID NO: 92 | (same as above) | EGR3 | 92% |
| SEQ ID NO: 75 | SEQ ID NO: 92 | (same as above) | EGR3 | 92% |
| SEQ ID NO: 76 | SEQ ID NO: 93 | (same as above) | EGR3 | 80% |
| SEQ ID NO: 77 | SEQ ID NO: 93 | (same as above) | EGR3 | 80% |
| SEQ ID NO: 78 | SEQ ID NO: 94 | HACPAEGCDRRFSRRDELNVHLRIHTGHKPFQCRICMRSFSSRRTCRAHIRTHTGEKPFACEFCGRKFAQSSNLVRHAKIHLKQKEHACPAEGCDRRFSQLAHLRAHLRIHTGHKPFQCRICMRSFSTSGNLVRHIRTHTGEKPFACEFCGRKFAHRTTLTNHAKIHLKQKE | EGR3 | 45% |
| SEQ ID NO: 79 | SEQ ID NO: 94 | (same as above) | EGR3 | 45% |
| SEQ ID NO: 80 | SEQ ID NO: 94 | (same as above) | EGR3 | 45% |

TABLE 8

Amino acid sequences of exemplary TADs that can be fused to any DBD of an eTF disclosed herein

| TAD SEQ ID NO. | TAD Sequence (N- to C-terminus) | TAD Protein Platform |
| --- | --- | --- |
| SEQ ID NO: 95 | DALDDFDLDMLGSDALDDFDLDMLGSDALDDFDLDMLGSDALDDFDLD ML | VP64 (a viral activator domain) |
| SEQ ID NO: 114 | DALDDFDLDMLGSDALDDFDLDMLGSDALDDFDLDMLGSDALDDFDLD MLINSRSSGSPKKKRKVGSQYLPDTDDRHRIEEKRKRTYETFKSEVIKKSPF SGPTDPRPPPRRIAVPSRSSASVPKPAPQPYPFTSSLSTINYDEFPTMVFPSG QISQASALAPAPPQVLPQAPAPAPAPAMVSALAQAPAPVPVLAPGPPQAV APPAPKPTQAGEGTLSEALLQLQFDDEDLGALLGNSTDPAVFTDLASVDN SEFQQLLNQGIPVAPHTTEPMLMEYPEAITRLVTGAQRPPDPAPAPLGAPG LPNGLLSGDEDFSSIADMDFSALLGSGSGSRDSREGMTIPKPEAGSAISDVF EGREVCQPKRIRPFHPPGSPWANRPLPASLAPTPTGPVHEPVGSLTPAPVPQ PLDPAPAVTPEASHLLEDPDEETSQAVKALREMADTVIPQKEEAAICGQM DLSHPPPRGHLDELTTTLESMTEDLNLDSPLTPELNEILDTFLNDECLLHAM HISTGLSIFDTSLF | VPR (a viral activator domain) |
| SEQ ID NO: 96 | MSGLEMADHMMAMNHGRFPDGTNGLHHHPAHRMGMGQFPSPHHHQQQ QPQHAFNALMGEHIHYGAGNMNATSGVRHAMGPGTVNGGHPPSALAPA ARFNNSQFMGPPVASQGGSLPASMQLQKLNNQYFNHHPYPHNHYMPDLH PAAGHQMNGTNQHFRDCNPKHSGGSSTPGGSGGSSTPGGSGSSSGGGAGS SNSGGGSGSGNMPASVAHVPAAMLPPNVIDTDFIDEEVLMSLVIEMGLDRI KELPELWLGQNEFDFMTDEVCKQQPSRVSC | CITED2 (human protein domain) |
| SEQ ID NO: 97 | MADHLMLAEGYRLVQRPPSAAAAHGPHALRTLPPYAGPGLDSGLRPRGA PLGPPPPRQPGALAYGAFGPPSSFQPFPAVPPPAAGIAHLQPVATPYPGRAA APPNAPGGPPGPQPAPSAAAPPPPAHALGGMDAELIDEEALTSLELELGLH RVRELPELFLGQSEFDCFSDLGSAPPAGSVSC | CITED4 (human protein domain) |
| SEQ ID NO: 98 | SGLEMADHMMAMNHGRFPDGTNGLHHHPAHRMGMGQFPSPHHHQQQ PQHAFNALMGEHIHYGAGNMNATSGVRHAMGPGTVNGGHPPSALAPAA RENNSQFMGPPVASQGGSLPASMQLQKLNNQYFNHHPYPHNHYMPDLHP AAGHQMNGTNQHFRDCNPKHSGGSSTPGGSGGSSTPGGSGSSSGGGAGSS NSGGGSGSGNMPASVAHVPAAMLPPNVIDTDFEDEEVLMSLVIEMGLDRI KELPELWLGQNEFDFMTDEVCKQQPSRVSC | CITED2 (human protein domain) |
| SEQ ID NO: 99 | MSGLEMADHMMAMNHGRFPDGTNGLHHHPAHRMGMGQFPSPHHHQQQ QPQHAFNALMGEHIHYGAGNMNATSGVRHAMGPGTVNGGHPPSALAPA ARENNSQFMGPPVASQGGSLPASMQLQKLNNQYFNHHPYPHNHYMPDLH PAAGHQMNGTNQHFRDCNPKHSGGSSTPGGSGGSSTPGGSGSSSGGGAGS SNSGGGSGSGNMPASVAHVPAAMLPPNVIDTDFEDEEVLMSLVIEMGLDRI KELPELWLGQNEFDFMTDEVCKQQPSRVSC | CITED2 (human protein domain) |
| SEQ ID NO: 100 | AADHLMLAEGYRLVQRPPSAAAAHGPHALRTLPPYAGPGLDSGLRPRGA PLGPPPPRQPGALAYGAFGPPSSFQPFPAVPPPAAGIAHLQPVATPYPGRAA APPNAPGGPPGPQPAPSAAAPPPPAHALGGMDAELIDEEALTSLELELGLH RVRELPELFLGQSEFDCFSDLGSAPPAGSVSC | CITED4 (human protein domain) |

TABLE 9

Percent sequence identity between TAD and protein platform

| eTF SEQ ID NO: | DBD SEQ ID NO: | TAD SEQ ID NO: | Protein Platform for TAD | Position of TAD relative to DBD | NCBI-BLAST Sequence Identity (%) of TAD to Protein Platform |
| --- | --- | --- | --- | --- | --- |
| SEQ ID NO: 50 | SEQ ID NO: 81 | N/A | N/A | N/A | N/A |
| SEQ ID NO: 51 | SEQ ID NO: 81 | SEQ ID NO: 95 | VP64 | C-term | 0 |
| SEQ ID NO: 52 | SEQ ID NO: 81 | SEQ ID NO: 96 | CITED2 | c-term | 100 |
| SEQ ID NO: 53 | SEQ ID NO: 81 | SEQ ID NO: 97 | CITED4 | c-term | 100 |
| SEQ ID NO: 54 | SEQ ID NO: 81 | SEQ ID NO: 97 | CITED4 | N/C-term | 100 |
| SEQ ID NO: 55 | SEQ ID NO: 82 | SEQ ID NO: 96 | CITED2 | c-term | 100 |
| SEQ ID NO: 56 | SEQ ID NO: 83 | SEQ ID NO: 98 | CITED2 | n-term | 100 |
| SEQ ID NO: 57 | SEQ ID NO: 84 | SEQ ID NO: 96 | CITED2 | c-term | 100 |
| SEQ ID NO: 58 | SEQ ID NO: 85 | SEQ ID NO: 99 | CITED2 | n-term | 100 |
| SEQ ID NO: 59 | SEQ ID NO: 86 | SEQ ID NO: 96 | CITED2 | c-term | 100 |
| SEQ ID NO: 60 | SEQ ID NO: 87 | SEQ ID NO: 99 | CITED2 | n-term | 100 |
| SEQ ID NO: 61 | SEQ ID NO: 88 | SEQ ID NO: 97 | CITED4 | c-term | 100 |
| SEQ ID NO: 62 | SEQ ID NO: 88 | SEQ ID NO: 97 | CITED4 | n/c-term | 100 |
| SEQ ID NO: 63 | SEQ ID NO: 89 | SEQ ID NO: 97 | CITED4 | c-term | 100 |

TABLE 9-continued

Percent sequence identity between TAD and protein platform

| eTF SEQ ID NO: | DBD SEQ ID NO: | TAD SEQ ID NO: | Protein Platform for TAD | Position of TAD relative to DBD | NCBI-BLAST Sequence Identity (%) of TAD to Protein Platform |
|---|---|---|---|---|---|
| SEQ ID NO: 64 | SEQ ID NO: 89 | SEQ ID NO: 97 | CITED4 | n/C-term | 100 |
| SEQ ID NO: 65 | SEQ ID NO: 82 | SEQ ID NO: 97 | CITED4 | C-term | 100 |
| SEQ ID NO: 66 | SEQ ID NO: 82 | SEQ ID NO: 97 | CITED4 | N/C-term | 100 |
| SEQ ID NO: 67 | SEQ ID NO: 90 | SEQ ID NO: 100 | CITED4 | N/C-term | 100 |
| SEQ ID NO: 68 | SEQ ID NO: 90 | SEQ ID NO: 100 | CITED4 | N-term | 100 |
| SEQ ID NO: 69 | SEQ ID NO: 91 | SEQ ID NO: 100 | CITED4 | N-term | 100 |
| SEQ ID NO: 70 | SEQ ID NO: 92 | SEQ ID NO: 96 | CITED2 | c-term | 100 |
| SEQ ID NO: 71 | SEQ ID NO: 92 | SEQ ID NO: 99 | CITED2 | n-term | 100 |
| SEQ ID NO: 72 | SEQ ID NO: 93 | SEQ ID NO: 6 | CITED2 | c-term | 100 |
| SEQ ID NO: 73 | SEQ ID NO: 93 | SEQ ID NO: 99 | CITED2 | n-term | 100 |
| SEQ ID NO: 74 | SEQ ID NO: 92 | SEQ ID NO: 97 | CITED4 | c-term | 100 |
| SEQ ID NO: 75 | SEQ ID NO: 92 | SEQ ID NO: 97 | CITED4 | n/c-term | 100 |
| SEQ ID NO: 76 | SEQ ID NO: 93 | SEQ ID NO: 97 | CITED4 | c-term | 100 |
| SEQ ID NO: 77 | SEQ ID NO: 93 | SEQ ID NO: 97 | CITED4 | n/c-term | 100 |
| SEQ ID NO: 78 | SEQ ID NO: 94 | SEQ ID NO: 96 | CITED2 | C-term | 100 |
| SEQ ID NO: 79 | SEQ ID NO: 94 | SEQ ID NO: 97 | CITED4 | N/C-term | 100 |
| SEQ ID NO: 80 | SEQ ID NO: 94 | SEQ ID NO: 97 | CITED4 | C-term | 100 |

TABLE 10

Examples of eTFs and their target site sequences

| eTF | Target Site recognized by eTF | Target site sequence (5'-to-3') | Gene Target |
|---|---|---|---|
| SEQ ID NO: 50 | SEQ ID NO: 33 | AGT GAT AGA GAA CGT ATG | Reporter |
| SEQ ID NO: 51 | SEQ ID NO: 33 | AGT GAT AGA GAA CGT ATG | Reporter |
| SEQ ID NO: 52 | SEQ ID NO: 33 | AGT GAT AGA GAA CGT ATG | Reporter |
| SEQ ID NO: 53 | SEQ ID NO: 33 | AGT GAT AGA GAA CGT ATG | Reporter |
| SEQ ID NO: 54 | SEQ ID NO: 33 | AGT GAT AGA GAA CGT ATG | Reporter |
| SEQ ID NO: 55 | SEQ ID NO: 33 | AGT GAT AGA GAA CGT ATG | Reporter |
| SEQ ID NO: 56 | SEQ ID NO: 33 | AGT GAT AGA GAA CGT ATG | Reporter |
| SEQ ID NO: 57 | SEQ ID NO: 35 | CTAGGTCAAGTGTAGGAG | SCN1A |
| SEQ ID NO: 58 | SEQ ID NO: 35 | CTAGGTCAAGTGTAGGAG | SCN1A |
| SEQ ID NO: 59 | SEQ ID NO: 38 | GAGTAGAAAAGAAACACA | PGRN |
| SEQ ID NO: 60 | SEQ ID NO: 38 | GAGTAGAAAAGAAACACA | PGRN |
| SEQ ID NO: 61 | SEQ ID NO: 35 | CTAGGTCAAGTGTAGGAG | SCN1A |
| SEQ ID NO: 62 | SEQ ID NO: 35 | CTAGGTCAAGTGTAGGAG | SCN1A |
| SEQ ID NO: 63 | SEQ ID NO: 38 | GAGTAGAAAAGAAACACA | PGRN |
| SEQ ID NO: 64 | SEQ ID NO: 38 | GAGTAGAAAAGAAACACA | PGRN |
| SEQ ID NO: 65 | SEQ ED NO: 33 | AGT GAT AGA GAA CGT ATG | Reporter |
| SEQ ID NO: 66 | SEQ ID NO: 33 | AGT GAT AGA GAA CGT ATG | Reporter |
| SEQ ID NO: 67 | SEQ ID NO: 36 | TAGGTACCATAGAGTGAG | SCN1A |
| SEQ ID NO: 68 | SEQ ID NO: 36 | TAGGTACCATAGAGTGAG | SCN1A |
| SEQ ID NO: 69 | SEQ ID NO: 35 | CTAGGTCAAGTGTAGGAG | SCN1A |
| SEQ ID NO: 70 | SEQ ID NO: 35 | CTAGGTCAAGTGTAGGAG | SCN1A |
| SEQ ID NO: 71 | SEQ ID NO: 35 | CTAGGTCAAGTGTAGGAG | SCN1A |
| SEQ ID NO: 72 | SEQ ID NO: 38 | GAGTAGAAAAGAAACACA | PGRN |

TABLE 10-continued

Examples of eTFs and their target site sequences

| eTF | Target Site recognized by eTF | Target site sequence (5'-to-3') | Gene Target |
| --- | --- | --- | --- |
| SEQ ID NO: 73 | SEQ ID NO: 38 | GAGTAGAAAAGAAACACA | PGRN |
| SEQ ID NO: 74 | SEQ ID NO: 35 | CTAGGTCAAGTGTAGGAG | SCN1A |
| SEQ ID NO: 75 | SEQ ID NO: 35 | CTAGGTCAAGTGTAGGAG | SCN1A |
| SEQ ID NO: 76 | SEQ ID NO: 38 | GAGTAGAAAAGAAACACA | PGRN |
| SEQ ID NO: 77 | SEQ ID NO: 38 | GAGTAGAAAAGAAACACA | PGRN |
| SEQ ID NO: 78 | SEQ ID NO: 33 | AGT GAT AGA GAA CGT ATG | Reporter |
| SEQ ID NO: 79 | SEQ ID NO: 33 | AGT GAT AGA GAA CGT ATG | Reporter |
| SEQ ID NO: 80 | SEQ ID NO: 33 | AGT GAT AGA GAA CGT ATG | Reporter |

TABLE 11

Example of a dSaCas9 protein sequence and guide RNAs for targeting a target site capable of upregulating the endogenous SCN1A gene.

dCas Scaffold

| SEQ ID NO: 102 | GTTTTAGTACTCTGGAAACAGAATCTACTAAAACAAGGCAAAATGCCGTGTTTATCTCGTC<br>AACTTGTTGGCGAGA |
| --- | --- | dSaCas9 Amino Acid Sequence

| SEQ ID NO: 103 | KRNYILGLAIGITSVGYGIIDYETRDVIDAGVRLFKEANVENNEGRRSKRGARRLKRRRRHRIQR<br>VKKLLFDYNLLTDHSELSGINPYEARVKGLSQKLSEEEFSAALLHLAKRRGVHNVNEVEEDTG<br>NELSTKEQISRNSKALEEKYVAELQLERLKKDGEVRGSINRFKTSDYVKEAKQLLKVQKAYHQ<br>LDQSFIDTYEDLLETRRTYYEGPGEGSPFGWKDIKEWYEMLMGHCTYFPEELRSVKYAYNADL<br>YNALNDLNNLVITRDENEKLEYYEKFQIIENVEKQKKKPTLKQIAKEILVNEEDIKGYRVTSTGK<br>PEFTNLKVYHDIKDITARKEHENAELLDQIAKILTIYQSSEDIQEELTNLNSELTQEEIEQISNLKG<br>YTGTHNLSLKAINLILDELWHTNDNQIAIFNRLKLVPKKVDLSQQKEIPTTLVDDFILSPVVKRS<br>FIQSIKVINAIIKKYGLPNDIIIELAREKNSKDAQKMINEMQKRNRQTNERIEEIIRTTGKENAKYL<br>IEKIKLHDMQEGKCLYSLEAIPLEDLLNNPFNYEVDHIIPRSVSEDNSENNKVLVKQEEASKKGN<br>RTPFQYLSSSDSKISYETFKKHILNLAKGKGRISKTKKEYLLEERDINRFSVQKDFINRNLVDTRY<br>ATRGLMNLLRSYFRVNNLDVKVKSINGGFTSFLRRKWKFKKERNKGYKHHAEDALHANADFI<br>FKEWKKLDKAKKVMENQMFEEKQAESMPEIETEQEYKEIFITPHQIKHIKDEKDYKYSHRVDK<br>KPNRELINDTLYSTRKDDKGNTLIVNNLNGLYDKDNDKLKKLINKSPEKLLMYHHDPQTYQKL<br>KLIMEQYGDEKNPLYKYYEETGNYLTKYSKKDNGPVIKKIKYYGNKLNAHLDITDDYPNSRN<br>KVVKLSLKPYREDVYLDNGVYKEVTVKNLDVIKKENYYEVNSKCYEEAKKLKKISNQAEFIAS<br>FYNNDLIKINGELYRVIGVNNDLLNRIEVNMIDITYREYLENMNDKRPPRIIKTIASKTQSIKKYS<br>TDILGNLYEVSKKHPQIIKKG |
| --- | --- |
| SEQ ID NO: 104<br>(or SEQ ID NO: 103<br>with NLS and HA tag) | MAPKKKRKVGIHGVPAAKRNYILGLAIGITSVGYGIIDYETRDVEDAGVRLFKEANVENNEGRR<br>SKRGARRLKRRRRHRIQRVKKLLFDYNLLTDHSELSGINPYEARVKGLSQKLSEEEFSAALLHL<br>AKRRGVHNVNEVEEDTGNELSTKEQISRNSKALEEKYVAELQLERLKKDGEVRGSINREKTSD<br>YVKEAKQLLKVQKAYHQLDQSFIDTYEDLLETRRTYYEGPGEGSPFGWKDIKEWYEMLMGHC<br>TYFPEELRSVKYAYNADLYNALNDLNNLVITRDENEKLEYYEKFQIIENVEKQKKKPTLKQIAK<br>EILVNEEDEKGYRVTSTGKPEFTNLKVYHDIKDITARKEHENAELLDQIAKILTIYQSSEDIQEELT<br>NLNSELTQEEIEQISNLKGYTGTHNLSLKAINLILDELWHTNDNQIAIFNRLKLVPKKVDLSQQK<br>EIPTTLVDDFILSPVVKRSFIQSIKVINAIIKKYGLPNDIIELAREKNSKDAQKMINEMQKRNRQT<br>NERIEEHRTTGKENAKYLIEKIKLHDMQEGKCLYSLEAIPLEDLLNNPFNYEVDHIIPRSVSEDNS<br>FNNKVLVKQEEASKKGNRTPFQYLSSSDSKISYETFKKHILNLAKGKGRISKTKKEYLLEERDIN<br>RFSVQKDFINRNLVDTRYATRGLMNLLRSYFRVNNLDVKVKSINGGFTSFLRRKWKFKKERNK<br>GYKHHAEDALHANADFIFKEWKKLDKAKKVMENQMFEEKQAESMPEIETEQEYKEIFITPHQI<br>KHIKDEKDYKYSHRVDKKPNRELINDTLYSTRKDDKGNTLIVNNLNGLYDKDNDKLKKLINKS<br>PEKLLMYHHDPQTYQKLKLIMEQYGDEKNPLYKYYEETGNYLTKYSKKDNGPVIKKEYYGN<br>KLNAHLDITDDYPNSRNKVVKLSLKPYREDVYLDNGVYKEVTVKNLDVIKKENYYEVNSKCY<br>EEAKKLKKISNQAEFIASFYNNDLIKINGELYRVIGVNNDLLNRIEVNMIDITYREYLENMNDKR<br>PPRIIKTIASKTQSIKKYSTDILGNLYEVSKKHPQIIKKGKRPAATKKAGQAKKKKGSYPYDVP<br>DYALEDALDDFDLDMLGSDALDDFDLDMLGSDALDDFDLDMLGSDALDDFDLDML |

SaCas9 Guide RNA (gRNA) Sequences

| SEQ ID NO: 105 | TGACCTAGACAGCCTTACATA |
| --- | --- |
| SEQ ID NO: 106 | TAAGGCTGTCTAGGTCAAGTG |

TABLE 11-continued

Example of a dSaCas9 protein sequence and guide RNAs for targeting a target site capable of upregulating the endogenous SCN1A gene.

| | |
|---|---|
| SEQ ID NO: 107 | AAGGCTGTCTAGGTCAAGTGT |
| SEQ ID NO: 108 | GATGAAGCCGAGAGGATACTG |
| SEQ ID NO: 109 | GCTGATTTGTATTAGGTACCA |

SpCas9 Guide RNA (gRNA) Sequences

| | |
|---|---|
| SEQ ID NO: 110 | CTTCGTTATGTAAGGCTGTCT |
| SEQ ID NO: 107 | AAGGCTGTCTAGGTCAAGTGT |
| SEQ ID NO: 111 | CAAGTGTAGGAGACACACTGC |

TABLE 12

Examples of zinc fingers that can be combined in eTFs to modulate SCN1A gene.

| | Sequence | | Sequence |
|---|---|---|---|
| SEQ ID NO: 115 | RSDNLVR | SEQ ID NO: 123 | QSGDLRR |
| SEQ ID NO: 116 | REDNLHT | SEQ ID NO: 124 | TSHSLTE |
| SEQ ID NO: 117 | RSDELVR | SEQ ID NO: 125 | THLDL1R |
| SEQ ID NO: 118 | QSGNLTE | SEQ ID NO: 126 | QSSSLVR |
| SEQ ID NO: 119 | TSGHLVR | SEQ ID NO: 127 | TSGNLVR |
| SEQ ID NO: 120 | QNSTLTE | SEQ ID NO: 128 | RRDELNV |
| SEQ ID NO: 121 | DPGALVR | SEQ ID NO: 129 | RSDDLVR |
| SEQ ID NO: 122 | HRTTLTN | SEQ ID NO: 130 | RSDHLTN |

TABLE 13

Examples of DBDs of eTFs for modulating SCN1A

Amino Acid Sequence of DBDs (including linkers)

| | |
|---|---|
| SEQ ID NO: 131 | LEPGEKPYKCPECGKSFSRSDNLVRHQRTHTGEKPYKCPECGKSFSREDNLHTHQRTHT GEKPYKCPECGKSFSRSDELVRHQRTHTGEKPYKCPECGKSFSQSGNLTEHQRTHTGEKP YKCPECGKSFSTSGHLVRHQRTHTGEKPYKCPECGKSFSQNSTLTEHQRTHTGKKTS |
| SEQ ID NO: 132 | LEPGEKPYKCPECGKSFSRSDNLVRHQRTHTGEKPYKCPECGKSFSHRTTLTNHQRTHTG EKPYKCPECGKSFSREDNLHTHQRTHTGEKPYKCPECGKSFSTSHSLTEHQRTHTGEKPY KCPECGKSFSQSSSLVRHQRTHTGEKPYKCPECGKSFSREDNLHTHQRTHTGKKTS |
| SEQ ID NO: 133 | LEPGEKPYKCPECGKSFSDPGALVRHQRTHTGEKPYKCPECGKSFSRSDNLVRHQRTHT GEKPYKCPECGKSFSQSGDLRRHQRTHTGEKPYKCPECGKSFSTHLDLIRHQRTHTGEKP YKCPECGKSFSTSGNLVRHQRTHTGEKPYKCPECGKSFSRSDNLVRHQRTHTGKKTS |
| SEQ ID NO: 134 | LEPGEKPYKCPECGKSFSRRDELNVHQRTHTGEKPYKCPECGKSFSRSDHLTNHQRTHT GEKPYKCPECGKSFSRSDDLVRHQRTHTGEKPYKCPECGKSFSRSDNLVRHQRTHTGEK PYKCPECGKSFSHRTTLTNHQRTHTGEKPYKCPECGKSFSREDNLHTHQRTHTGEKPYK CPECGKSFSTSHSLTEHQRTHTGEKPYKCPECGKSFSQSSSLVRHQRTHTGEKPYKCPEC GKSFSREDNLHTHQRTHTGKKTS |
| SEQ ID NO: 135 | RSDNLVR x REDNLHT x RSDELVR x QSGNLTE x TSGHLVR x QNSTLTE (wherein X indicates a linker comprising 1-50 amino acid residues) |
| SEQ ID NO: 371 | RSDNLVR x HRTTLTN x REDNLHT x TSHSLTE x QSSSLVR x REDNLHT (wherein X indicates a linker comprising 1-50 amino acid residues) |
| SEQ ID NO: 372 | RRDELNV x RSDHLTN x RSDDLVR x RSDNLVR x HRTTLTN x REDNLHT x TSHSLTE x QSSSLVR x REDNLHT (wherein X indicates a linker comprising 1-50 amino acid residues) |
| SEQ ID NO: 376 | DPGALVR x RSDNLVR x QSGDLRR x THLDLIR x TSGNLVR x RSDNLVR (wherein X indicates a linker comprising 1-50 amino acid residues) |
| SEQ ID NO: 423 | LEPGEKPYKCPECGKSFSRSDNLVRHQRTHTGEKPYKCPECGKSFSREDNLHTHQRTHT GEKPYKCPECGKSFSRSDELVRHQRTHTGEKPYKCPECGKSFSQSGNLTEHQRTHTGEKP YKCPECGKSFSTSGHLVRHQRTHTGEKPYKCPECGKSFSQNSTLTEHQRTHTGKKTS |

TABLE 13-continued

| Examples of DBDs of eTFs for modulating SCN1A | |
|---|---|
| | Amino Acid Sequence of DBDs (including linkers) |
| SEQ ID NO: 424 | LEPGEKPYKCPECGKSFSRSDNLVRHQRTHTGEKPYKCPECGKSFSREDNLHTHQRTHT GEKPYKCPECGKSFSRSDELVRHQRTHTGEKPYKCPECGKSFSQSGNLTEHQRTHTGEKP YKCPECGKSFSTSGHLVRHQRTHTGEKPYKCPECGKSFSQNSTLTEHQRTHTGKKTS |
| SEQ ID NO: 425 | LEPGEKPYKCPECGKSFSRSDNLVRHQRTHTGEKPYKCPECGKSFSREDNLHTHQRTHT GEKPYKCPECGKSFSRSDELVRHQRTHTGEKPYKCPECGKSFSQSGNLTEHQRTHTGEKP YKCPECGKSFSTSGHLVRHQRTHTGEKPYKCPECGKSFSQNSTLTEHQRTHTGKKTS |
| SEQ ID NO: 426 | LEPGEKPYKCPECGKSFSRSDNLVRHQRTHTGEKPYKCPECGKSFSHRTTLTNHQRTHTG EKPYKCPECGKSFSREDNLHTHQRTHTGEKPYKCPECGKSFSTSHSLTEHQRTHTGEKPY KCPECGKSFSQSSSLVRHQRTHTGEKPYKCPECGKSFSREDNLHTHQRTHTGKKTS |
| SEQ ID NO: 427 | RKYPNRPSKTPPHERPYACPVESCDRRFSRSDNLVRHIRIHTGQKPFQCRICMRNFSREDN LHTHIRTHTGEKPFACDICGRKFARSDELVRHTKIHLRQKDRPYACPVESCDRRFSQSGN LTEHIRIHTGQKPFQCRICMRNFSTSGHLVRHIRTHTGEKPFACDICGRKFAQNSTLTEHT KIHLRQKDKKADKSVV |
| SEQ ID NO: 428 | RKYPNRPSKTPPHERPYACPVESCDRRFSRSDNLVRHIRIHTGQKPFQCRICMRNFSREDN LHTHIRTHTGEKPFACDICGRKFARSDELVRHTKIHLRQKDRPYACPVESCDRRFSQSGN LTEHIRIHTGQKPFQCRICMRNFSTSGHLVRHIRTHTGEKPFACDICGRKFAQNSTLTEHT KIHLRQKDKKADKSVV |
| SEQ ID NO: 429 | RKYPNRPSKTPPHERPYACPVESCDRRFSRSDNLVRHIRIHTGQKPFQCRICMRNFSREDN LHTHIRTHTGEKPFACDICGRKFARSDELVRHTKIHLRQKDRPYACPVESCDRRFSQSGN LTEHIRIHTGQKPFQCRICMRNFSTSGHLVRHRTHTGEKPFACDICGRKFAQNSTLTEHT KIHLRQKDK |
| SEQ ID NO: 430 | RKYPNRPSKTPPHERPYACPVESCDRRFSRSDNLVRHIRIHTGQKPFQCRICMRNFSREDN LHTHIRTHTGEKPFACDICGRKFARSDELVRHTKIHLRQKDRPYACPVESCDRRFSQSGN LTEHIRIHTGQKPFQCRICMRNFSTSGHLVRHRTHTGEKPFACDICGRKFAQNSTLTEHT KIHLRQKDK |
| SEQ ID NO: 431 | RKYPNRPSKTPPHERPYACPVESCDRRFSRSDNLVRHIRIHTGQKPFQCRICMRNFSHRTT LTNHIRTHTGEKPFACDICGRKFAREDNLHTHIRTHTGEKPFACDICGRKFSTSHSLTEHIR IHTGQKPFQCRICMRNFSQSSSLVRHIRTHTGEKPFACDICGRKFAREDNLHTHTKIHLRQ KDKKADKSVV |
| SEQ ID NO: 432 | QSQLEKPSRMRKYPNRPSKTPPHERPYACPVESCDRRFSRSDNLVRHIRIHTGQKPFQCRI CMRNFSHRTTLTNHIRTHTGEKPFACDICGRKFAREDNLHTHTKIHLRQKDRPYACPVES CDRRFSTSHSLTEHIRIHTGQKPFQCRICMRNFSQSSSLVRHIRTHTGEKPFACDICGRKFA REDNLHTHTKIHLRQKDK |
| SEQ ID NO: 433 | QSQLEKPSRMRKYPNRPSKTPPHERPYACPVESCDRRFSRSDNLVRHIRIHTGQKPFQCRI CMRNFSHRTTLTNHIRTHTGEKPFACDICGRKFAREDNLHTHTKIHLRQKDRPYACPVES CDRRFSTSHSLTEHIRIHTGQKPFQCRICMRNFSQSSSLVRHIRTHTGEKPFACDICGRKFA REDNLHTHTKIH |
| SEQ ID NO: 434 | QSQLEKPSRMRKYPNRPSKTPPHERPYACPVESCDRRFSRSDNLVRHIRIHTGQKPFQCRI CMRNFSHRTTLTNHIRTHTGEKPFACDICGRKFAREDNLHTHTKIHLRQKDRPYACPVES CDRRFSTSHSLTEHIRIHTGQKPFQCRICMRNFSQSSSLVRHIRTHTGEKPFACDICGRKFA REDNLHTHTKIHLRQKDK |
| SEQ ID NO: 435 | RKYPNRPSKTPPHERPYACPVESCDRRFSRSDNLVRHIRIHTGQKPFQCRICMRNFSHRTT LTNHIRTHTGEKPFACDICGRKFAREDNLHTHIRTHTGEKPFACDICGRKFSTSHSLTEHIR IHTGQKPFQCRICMRNFSQSSSLVRHIRTHTGEKPFACDICGRKFAREDNLHTHTKIHLRQ KDKKADKSVV |
| SEQ ID NO: 441 | RKYPNRPSKTPPHERPYACPVESCDRRFSRSDNLVRHIRIHTGQKPFQCRICMRNFSREDN LHTHIRTHTGEKPFACDICGRKFARSDELVRHIRTHTGEKPFACDICGRKFSQSGNLTEHI RIHTGQKPFQCRICMRNFSTSGHLVRHIRTHTGEKPFACDICGRKFAQNSTLTEHTKIHLR QKDKKADKSVV |
| SEQ ID NO: 406 | RKYPNRPSKTPPHERPYACPVESCDRRFSRSDNLVRHIRIHTGQKPFQCRICMRNFSHRTT LTNHIRTHTGEKPFACDICGRKFAREDNLHTHTKIHLRQKDRPYACPVESCDRRFSTSHSL TEHIRIHTGQKPFQCRICMRNFSQSSSLVRHIRTHTGEKPFACDICGRKFAREDNLHTHTKI HLRQKDKKADKSVV |
| SEQ ID NO: 407 | AAAKAEMQLMSPLQISDPFGSFPHSPTMDNYPKLEEMMLLSNGAPQFLGAAGAPEGSGS NSSSSSSGGGGGGGGGSNSSSSSSTFNPQADTGEQPYEHLTAESFPDISLNNEKVLVETSY PSQTTRLPPITYTGRFSLEPAPNSGNTLWPEPLFSLVSGLVSMTNPPASSSSAPSPAASSAS ASQSPPLSCAVPSNDSSPIYSAAPTFPTPNTDIFPEPQSQAFPGSAGTALQYPPPAYPAAKG GFQVPMIPDYLFPQQQGDLGLGTPDQKPFQGLESRTQQPSLTPLSTIKAFATQSGSQDLK ALNTSYQSQLEKPSRMRKYPNRPSKTPPHERPYACPVESCDRRFSRSDNLVRHIRIHTGQK PFQCRICMRNFSREDNLHTHIRTHTGEKPFACDICGRKFARSDELVRHTKIHLRQKDRPY ACPVESCDRRFSQSGNLTEHIRIHTGQKPFQCRICMRNFSTSGHLVRHIRTHTGEKPFACDI CGRKFAQNSTLTEHTKIHLRQKDKKADKSVVASSATSSLSSYPSPVATSYPSPVTTSYPSP |

TABLE 13-continued

| Examples of DBDs of eTFs for modulating SCN1A | |
|---|---|
| | Amino Acid Sequence of DBDs (including linkers) |
| | ATTSYPSPVPTSFSSPGSSTYPSPVHSGFPSPSVATTYSSVPPAFPAQVSSFPSSAVTNSFSA<br>STGLSDMTATFSPRTIEIC |
| SEQ ID NO: 408 | RPYACPVESCDRRFSDPGALVRHIRIHTGQKPFQCRICMRNFSRSDNLVRHIRTHTGEKPF<br>ACDICGRKFAQSGDLRRHTKIHLRQKDRPYACPVESCDRRFSTHLDLIRHIRIHTGQKPFQ<br>CRICMRNFSTSGNLVRHIRTHTGEKPFACDICGRKFARSDNLVRHTKIHLRQKDRPYACP<br>VESCDRRFSQSGHLTEHIRIHTGQKPFQCRICMRNFSERSHLREHIRTHTGEKPFACDICGR<br>KFAQAGHLASHTKIHLRQKD |
| SEQ ID NO: 409 | RKYPNRPSKTPPHERPYACPVESCDRRFSRSDNLVRHIRIHTGQKPFQCRICMRNFSREDN<br>LHTHIRTHTGEKPFACDICGRKFARSDELVRHIRTHTGEKPFACDICGRKFSQSGNLTEHI<br>RIHTGQKPFQCRICMRNFSTSGHLVRHIRTHTGEKPFACDICGRKFAQNSTLTEHTKIHLR<br>QKDKKADKSVV |
| SEQ ID NO: 391 | LEPGEKPYKCPECGKSFSDPGHLVRHQRTHTGEKPYKCPECGKSFSTKNSLTEHQRTHTG<br>EKPYKCPECGKSFSRNDALTEHQRTHTGEKPYKCPECGKSFSERSHLREHQRTHTGEKPY<br>KCPECGKSFSSKKHLAEHQRTHTGEKPYKCPECGKSFSTHLDLIRHQRTHTGEKPYKCPE<br>CGKSFSQSGNLTEHQRTHTGKKTS |
| SEQ ID NO: 392 | LEPGEKPYKCPECGKSFSSRRTCRAHQRTHTGEKPYKCPECGKSFSTTGALTEHQRTHTG<br>EKPYKCPECGKSFSRSDELVRHQRTHTGEKPYKCPECGKSFSRNDALTEHQRTHTGEKP<br>YKCPECGKSFSQSGDLRRHQRTHTGEKPYKCPECGKSFSTSHSLTEHQRTHTGKKTS |
| SEQ ID NO: 393 | LEPGEKPYKCPECGKSFSRKDNLKNHQRTHTGEKPYKCPECGKSFSDPGALVRHQRTHT<br>GEKPYKCPECGKSFSREDNLHTHQRTHTGEKPYKCPECGKSFSDPGALVRHQRTHTGEK<br>PYKCPECGKSFSTSGELVRHQRTHTGEKPYKCPECGKSFSRKDNLKNHQRTHTGKKTS |
| SEQ ID NO: 394 | LEPGEKPYKCPECGKSFSRSDNLVRHQRTHTGEKPYKCPECGKSFSREDNLHTHQRTHT<br>GEKPYKCPECGKSFSRSDELVRHQRTHTGEKPYKCPECGKSFSQSGNLTEHQRTHTGEKP<br>YKCPECGKSFSTSGHLVRHORTHTGEKPYKCPECGKSFSONSTLTEHORTHTGKKTS |
| SEQ ID NO: 395 | LEPGEKPYKCPECGKSFSSKKALTEHQRTHTGEKPYKCPECGKSFSSPADLTRHQRTHTG<br>EKPYKCPECGKSFSRSDNLVRHQRTHTGEKPYKCPECGKSFSREDNLHTHQRTHTGEKP<br>YKCPECGKSFSRSDELVRHQRTHTGEKPYKCPECGKSFSQSGNLTEHQRTHTGEKPYKCP<br>ECGKSFSTSGHLVRHQRTHTGEKPYKCPECGKSFSQNSTLTEHQRTHTGKKTS |
| SEQ ID NO: 396 | LEPGEKPYKCPECGKSFSSPADLTRHQRTHTGEKPYKCPECGKSFSRSDNLVRHQRTHTG<br>EKPYKCPECGKSFSREDNLHTHQRTHTGEKPYKCPECGKSFSRSDELVRHQRTHTGEKP<br>YKCPECGKSFSQSGNLTEHQRTHTGEKPYKCPECGKSFSTSGHLVRHQRTHTGKKTS |
| SEQ ID NO: 397 | LEPGEKPYKCPECGKSFSSKKALTEHQRTHTGEKPYKCPECGKSFSSPADLTRHQRTHTG<br>EKPYKCPECGKSFSRSDNLVRHQRTHTGEKPYKCPECGKSFSREDNLHTHQRTHTGEKP<br>YKCPECGKSFSRSDELVRHQRTHTGEKPYKCPECGKSFSQSGNLTEHQRTHTGKKTS |
| SEQ ID NO: 398 | LEPGEKPYKCPECGKSFSDCRDLARHQRTHTGEKPYKCPECGKSFSRNDALTEHQRTHT<br>GEKPYKCPECGKSFSRNDALTEHQRTHTGEKPYKCPECGKSFSSPADLTRHQRTHTGEKP<br>YKCPECGKSFSDPGNLVRHQRTHTGEKPYKCPECGKSFSQRAHLERHQRTHTGEKPYKC<br>PECGKSFSQSSSLVRHQRTHTGEKPYKCPECGKSFSHRTTLTNHQRTHTGKKTS |
| SEQ ID NO: 399 | LEPGEKPYKCPECGKSFSRNDALTEHQRTHTGEKPYKCPECGKSFSSPADLTRHQRTHTG<br>EKPYKCPECGKSFSDPGNLVRHQRTHTGEKPYKCPECGKSFSQRAHLERHQRTHTGEKP<br>YKCPECGKSFSQSSSLVRHQRTHTGEKPYKCPECGKSFSHRTTLTNHQRTHTGKKTS |
| SEQ ID NO: 400 | LEPGEKPYKCPECGKSFSTKNSLTEHQRTHTGEKPYKCPECGKSFSRADNLTEHQRTHTG<br>EKPYKCPECGKSFSQLAHLRAHQRTHTGEKPYKCPECGKSFSTKNSLTEHQRTHTGEKP<br>YKCPECGKSFSQAGHLASHQRTHTGEKPYKCPECGKSFSTHLDLIRHQRTHTGKKTS |
| SEQ ID NO: 401 | LEPGEKPYKCPECGKSFSRNDALTEHQRTHTGEKPYKCPECGKSFSDPGHLVRHQRTHT<br>GEKPYKCPECGKSFSTSGELVRHQRTHTGEKPYKCPECGKSFSTHLDLIRHQRTHTGEKP<br>YKCPECGKSFSSKKALTEHQRTHTGEKPYKCPECGKSFSQLAHLRAHQRTHTGEKPYKC<br>PECGKSFSRSDHLTNHQRTHTGKKTS |
| SEQ ID NO: 402 | LEPGEKPYKCPECGKSFSRSDNLVRHQRTHTGEKPYKCPECGKSFSHRTTLTNHQRTHTG<br>EKPYKCPECGKSFSREDNLHTHQRTHTGEKPYKCPECGKSFSTSHSLTEHQRTHTGEKPY<br>KCPECGKSFSQSSSLVRHQRTHTGEKPYKCPECGKSFSREDNLHTHQRTHTGKKTS |
| SEQ ID NO: 403 | LEPGEKPYKCPECGKSFSDPGALVRHQRTHTGEKPYKCPECGKSFSRSDNLVRHQRTHT<br>GEKPYKCPECGKSFSQSGDLRRHQRTHTGEKPYKCPECGKSFSTHLDLIRHQRTHTGEKP<br>YKCPECGKSFSTSGNLVRHQRTHTGEKPYKCPECGKSFSRSDNLVRHQRTHTGKKTS |
| SEQ ID NO: 404 | LEPGEKPYKCPECGKSFSQAGHLASHQRTHTGEKPYKCPECGKSFSREDNLHTHQRTHT<br>GEKPYKCPECGKSFSTSGNLTEHQRTHTGEKPYKCPECGKSFSTHLDLIRHQRTHTGEKP<br>YKCPECGKSFSQKSSLIAHQRTHTGEKPYKCPECGKSFSQAGHLASHQRTHTGKKTS |

TABLE 13-continued

Examples of DBDs of eTFs for modulating SCN1A

Amino Acid Sequence of DBDs (including linkers)

SEQ ID NO: 405   LEPGEKPYKCPECGKSFSTTGNLTVHQRTHTGEKPYKCPECGKSFSTSGELVRHQRTHTG
EKPYKCPECGKSFSREDNLHTHQRTHTGEKPYKCPECGKSFSTSGNLTEHQRTHTGEKPY
KCPECGKSFSQSSSLVRHQRTHTGEKPYKCPECGKSFSQRANLRAHQRTHTGKKTS

TABLE 14

Examples of DNA binding domains comprising multiple zinc fingers that modulate SCN1A

| Number of ZFs in DBD | DBD comprising the following ZFs (N-to-C terminus): | ZF Sequences: | DBD SEQ ID NO. |
| --- | --- | --- | --- |
| 6 | SEQ ID NO: 115<br>SEQ ID NO: 116<br>SQE ID NO: 117<br>SEQ ID NO: 118<br>SEQ ID NO: 119<br>SEQ ID NO: 120 | RSDNLVR;<br>REDNLHT;<br>RSDELVR;<br>QSGNLTE;<br>TSGHLVR;<br>QNSTLTE | SEQ ID NO: 131 |
| 6 | SEQ ID NO: 115<br>SEQ ID NO: 122<br>SEQ ID NO: 116<br>SEQ ID NO: 124<br>SEQ ID NO: 126<br>SEQ ID NO: 116 | RSDNLVR;<br>HRTTLTN;<br>REDNLHT;<br>TSHSLTE;<br>QSSSLVR;<br>REDNLHT | SEQ ID NO: 132 |
| 6 | SEQ ID NO: 121<br>SEQ ID NO: 115<br>SEQ ID NO: 123<br>SEQ ID NO: 125<br>SEQ ID NO: 127<br>SEQ ID NO: 115 | DPGALVR;<br>RSDNLVR;<br>QSGDLRR;<br>THLDLIR;<br>TSGNLVR;<br>RSDNLVR | SEQ ID NO: 133 |
| 9 | SEQ ID NO: 128<br>SEQ ID NO: 130<br>SEQ ID NO: 129<br>SEQ ID NO: 115<br>SEQ ID NO: 122<br>SEQ ID NO: 116<br>SEQ ID NO: 124<br>SEQ ID NO: 126<br>SEQ ID NO: 116 | RRDELNV;<br>RSDHLTN;<br>RSDDLVR;<br>RSDNLVR;<br>HRTTLTN;<br>REDNLHT;<br>TSHSLTE;<br>QSSSLVR;<br>REDNLHT | SEQ ID NO: 134 |

TABLE 15

Examples of target site sequences for modulating SCN1A

| Target Sequence SEQ ID NO. | Recognized by ZF or gRNA | SCN1A target site sequences recognized by an eTF |
| --- | --- | --- |
| SEQ ID NO: 35 | ZF | CTAGGTCAAGTGTAGGAG |
| SEQ ID NO: 36 | ZF | TAGGTACCATAGAGTGAG |
| SEQ ID NO: 37 | ZF | TAGGTACCATAGAGTGAGGCGAGGATG |
| SEQ ID NO: 136 | ZF | GAGGATACTGCAGAGGTC |
| SEQ ID NO: 252 | ZF | CAAACTCCCAGCCTGCCTGGC |
| SEQ ID NO: 253 | ZF | CCAGCACTGGTGCTTCGT |
| SEQ ID NO: 254 | ZF | AAGGCTGTCTAGGTCAAG |
| SEQ ID NO: 256 | ZF | CTAGGTCAAGTGTAGGAGACACAC |
| SEQ ID NO: 257 | ZF | GGTCAAGTGTAGGAGACA |
| SEQ ID NO: 258 | ZF | CAAGTGTAGGAGACACAC |
| SEQ ID NO: 259 | ZF | AGTGTAGGAGACACACTGCTGGCC |
| SEQ ID NO: 260 | ZF | AGTGTAGGAGACACACTG |
| SEQ ID NO: 261 | ZF | ACTTGACCTAGACAGCCT |
| SEQ ID NO: 262 | ZF | AGGAGACACACTGCTGGCCTG |

TABLE 15-continued

Examples of target site sequences for modulating SCN1A

| Target Sequence SEQ ID NO. | Recognized by ZF or gRNA | SCN1A target site sequences recognized by an eTF |
|---|---|---|
| SEQ ID NO: 264 | ZF | TGAATAACTCATTAGTGA |
| SEQ ID NO: 265 | ZF | AAAGTACATTAGGCTAAT |
| SEQ ID NO: 105 | gRNA | TGACCTAGACAGCCTTACATA |
| SEQ ID NO: 106 | gRNA | TAAGGCTGTCTAGGTCAAGTG |
| SEQ ID NO: 108 | gRNA | GATGAAGCCGAGAGGATACTG |
| SEQ ID NO: 109 | gRNA | GCTGATTTGTATTAGGTACCA |
| SEQ ID NO: 110 | gRNA | CTTCGTTATGTAAGGCTGTCT |
| SEQ ID NO: 107 | gRNA | AAGGCTGTCTAGGTCAAGTGT |
| SEQ ID NO: 111 | gRNA | CAAGTGTAGGAGACACACTGC |
| SEQ ID NO: 195 | gRNA | CACTCATTGAGGACAGAAGCA |
| SEQ ID NO: 196 | gRNA | ACAAAGTGGAGAGACTACCCG |
| SEQ ID NO: 197 | gRNA | GGTACGGGCAAAGATTTCTTG |
| SEQ ID NO: 198 | gRNA | TTTGCCCGTACCAAAGTCTTG |
| SEQ ID NO: 199 | gRNA | TCTTCAGCCACAAAAAAAAAA |
| SEQ ID NO: 200 | gRNA | GTGTGCAACCCATGAGGTCGC |
| SEQ ID NO: 201 | gRNA | ACACAATGAGCCACCTACAAG |
| SEQ ID NO: 202 | gRNA | GTGGCTCATTGTGTGTGTGCC |
| SEQ ID NO: 203 | gRNA | AGAAAGCTGATACAGATACAA |
| SEQ ID NO: 205 | gRNA | AAACCAGCAACAAACAGTATA |
| SEQ ID NO: 206 | gRNA | GAGAATCATCTAGGTCAGGAC |
| SEQ ID NO: 207 | gRNA | TTCTCAGTTTTGAAATTAAAA |
| SEQ ID NO: 208 | gRNA | CATATCCCTGCAGGTTCAGAA |
| SEQ ID NO: 209 | gRNA | TGGATTCTCTTCTGAACCTGC |
| SEQ ID NO: 210 | gRNA | AGAGAGAGAGAGAGAGAGAGA |
| SEQ ID NO: 211 | gRNA | TGGTCTCATTCTTTTGTGGG |
| SEQ ID NO: 224 | gRNA | TGTTCCTCCAGATTAACACTT |
| SEQ ID NO: 225 | gRNA | ATTACAGTTCTGTCAGCATGC |
| SEQ ID NO: 226 | gRNA | ATCATCTGTAACCATCAAGGA |
| SEQ ID NO: 227 | gRNA | TCCTGCCTACTTAGTTTCAAG |
| SEQ ID NO: 228 | gRNA | TGCTGAGGCAGGACACAGTGT |
| SEQ ID NO: 229 | gRNA | ACAAAGTAAGTGTCAGTGTGG |
| SEQ ID NO: 230 | gRNA | CTGACACTTACTTTGTCTAAA |
| SEQ ID NO: 231 | gRNA | ATAATAGTTGTGTCTTTATAA |
| SEQ ID NO: 232 | gRNA | CGATATTTTCATGGATTCCTT |
| SEQ ID NO: 233 | gRNA | AAAACTGGAACCGCATTCCCA |
| SEQ ID NO: 234 | gRNA | TGTACAAGCAGGGCTGCAAAG |
| SEQ ID NO: 235 | gRNA | AAAGGGGAATGGGAACACCCG |
| SEQ ID NO: 236 | gRNA | ATGTTCAAGGTGCAGAAGGAA |
| SEQ ID NO: 237 | gRNA | TTCAACAAGCTCCCAAGAAGT |
| SEQ ID NO: 238 | gRNA | GTTAACAAATACACTAAACAC |
| SEQ ID NO: 240 | gRNA | AAAACCGTCAACCCCATACAG |
| SEQ ID NO: 241 | gRNA | AGGAATCACTTGTCAGACCTA |
| SEQ ID NO: 242 | gRNA | GAGACTGTGCGTATAAAGGCA |
| SEQ ID NO: 243 | gRNA | TACTGATACAGGAACTGTGCC |
| SEQ ID NO: 244 | gRNA | CTTGTCATGAAACATGAGCTA |
| SEQ ID NO: 245 | gRNA | TATCTGTATTCCTTTTATTTT |
| SEQ ID NO: 246 | gRNA | ATAAATGGTAATTAAAATGTG |
| SEQ ID NO: 247 | gRNA | TGTTTGCTCAAACGTGCACCA |
| SEQ ID NO: 248 | gRNA | AAATATGTACCACAAGAAATG |
| SEQ ID NO: 249 | gRNA | TATCTGGTTTCTCTCACTGCT |
| SEQ ID NO: 250 | gRNA | AAATAAGACATGAAAACAAGA |
| SEQ ID NO: 251 | gRNA | ATTGCAAAGCATAATTTGGAT |

TABLE 16

Nucleic acid sequences of exemplary eTFs disclosed herein that can upregulate SCN1A expression

| eTF Protein SEQ ID NO: | Nucleic Acid SEQ ID NO: | Nucleic Acid Sequence |
|---|---|---|
| SEQ ID NO: 305 | SEQ ID NO: 353 | ggaggaagccatcaactaactacaatgactgtaagatacaaaattggaatgtaacatatttgaagttctgttgacataagaatcatg<br>atattaatgccatcagaagctgaaatgaaagggaaatgcatcaacactagtgccaccacctagagaccagatgtgtcgtggcagtgt<br>gctgtctctagcaatactcagagagagaagaacaatgaaatctgattggcccagtggcccagtgaggttcagctgccaactttt<br>ctcttcaatctcatgaaagtcattaagcacaactaactctttttttttttttgagacagagctctgagcccaggacagagtgc<br>agtagtgactcaatctcggctcactgcagcctccacctcccaggctcaaacggtcctcctgcatcagcctcccaagtagctgaattacag<br>gagtgcccaccatgccaccacggtccccaattgtattttaatagtaggtcggatatatggtcagccactacaaaacggacgggtctcgaactcctggctca<br>agtgatccacctgcctcggcctcccaaagtgctggattataggcgtcagcaacaaaacggacgggcctcgtgaaccagtgaggcccagagtgc<br>aaaaatgtattttcacatactagtattttacattttatccacacaaaacggacgggctgtaaatggagcgagcgcatagcaaaggacgc<br>gcataaataacccctgctgctgcaccacctgggagaggggaggaccacgtaaatgggagcccaggtgctgtcttgaggctcaaggaagcgtc<br>gggcatttctgcgcggtgcactgggtagctgtggccaggtgtggtacttgatgggggccaagaacgacgtcctctcacaaatatggagggagg<br>gcagggtcacagatctgggggaaacccggggaaagcactgaggcaaaaccgtcctctcacaaatatggagggagg<br>ttgagtacgttctggattactcataagaccttttttttttccttccggcgcaaaacgtgagctgattataatgccctataaagctccaga<br>ggcgtcaggcacctgcagaggagcccgcagctcgcgcagccgtagctgcccgagcactcgtgatttcccgcgatcc<br>ggtccccgcctcccactgccccgcttacccggaggcgtgcagcgcgtctcgaatctctcctcgatcctctcctggctcgtgcga<br>gaggaactagcgagacgaggaaagcagccggagctgaccgcgggacgcagattacgcgtcagggccgagccgagcggatcgctgg<br>gcgctgtcgagaggaaaggggagtgccggctgcctctctccggctctcgcagagccgagtggtaagctaagcgacactgacctgccagc<br>gccaaccgtggcttcagccaggtcctctcgccccaggagcgctaggaacggtaacctgttactttccaggggccgtagtgaccgctgcccagtt<br>gctgcgactgcgcgggcgcagctggacgcaagtgactgtggaagtgtgggaaGAGCTTTTCC<br>cttttcccctctcacctgtctcaccaaagtcccctagtcccggagcagtagcctctactaccagggaattagcagacacaacg<br>ggaaccagacaccgaaccagacatgccccgcttcagtccctccgtgccctccggtgtgcaagaccccggaagtcctccccgacagtctcgctctctttg<br>cagcctgttctgccgggacagtcgagtcggagactccggacgcagtagaggcccgacgtagaccgagctgGAATTCGCCACCA<br>TGGCCCCAAAGAAGAAGCGGAAGGTCGTATCCACGGAGTCCCAGCAGCCCTGA<br>ACCAGGTGAGAAACCTTACAAATGTCCTGAATGTGGGAAATCATTCAGTCGCAGC<br>GACAACCTGTGAGACATCAACGCACCCATACAGGAGAAAAAACCTTATAAATGTC<br>CAGAATGTGAAAAGTCCTTCTCACGAGAGATAACTTGCACACTCATCAACGAAC<br>ACATACTGGTGAAAAACCATACAAGTGTCCCGAATGTGGTAAAAGTTTTAGCCGG<br>AGCGATGAACTTGTCCGACACCAACGACCATACAGGCGAGAAGCCTTACAAAT<br>GTCCCGAGTGTGGCAAGAGTTCTCACAATGCAGGGAATCTGACTGAGCATCAACG<br>AACTCATACCCGGGGAAAAACCTTACAAGTGTCAGAGTGTGGGAAGAGCTTTTCC<br>ACAAGTGGACATCTGGTACGCCACCACAGAGGACACATACAGGGAGAAGCCCTACA<br>AATGCCCCGAATGCGGTAAAAGTTTCTCTCAGAATAGTACCTGACCGAACACCA<br>GCGACACACACTGGGAAAAAACAGAGTAAAAGGCCGGCGGCCACGAAAAGGC<br>CGGCCAGGCAAAAAGAAAAAGGATCCTACCCATACGACGTACCAGATTACGCT<br>CTCGAGGAGCCAGCGGTTCCGACGGGCTGACGCATTGACGATTTGATCTGG<br>ATATGCTGGAAGTGACGCCCTGCATGATTTTGACCTTGACATGCTTGGTTCGGAT<br>CCTTGACATGCTGATTAACTCTAGAAGTTCGGATCTCCGAAAAGAAACCAAA<br>GTTGGTAGCCAGTACCTGCCCGACCGACACCGGCCACCGGATCGAGGAAAAGC<br>GGAAGCGGACCTACGAGACATTCAAGAGACATCATGAAGAATCGCCGTCCCCCTTCAGCGG<br>CCCACCGACCCTAGACCTTCCACCTAGAAGAATCGCCGTGCCCAGCAGATCCAGC<br>GCCAGCCGTGCCAAAACCTGCCCCCCAGCCTTACCCCTTCACCAGCAGCCTGAGCAC |

TABLE 16-continued

Nucleic acid sequences of exemplary eTFs disclosed herein that can upregulate SCN1A expression

| eTF Protein SEQ ID NO: | Nucleic Acid SEQ ID NO: | Nucleic Acid Sequence |
|---|---|---|
| SEQ ID NO: 306 | | CATCAACTACGACGAGTTCCCTACCATGGTGTTCCCCAGCGCCAGATCTCTCAGG<br>CCTCTGCTCTGGCTCCAGCCCCTCCTCAGCTGTCCAGGCTCCTGCCTCCTGCAC<br>CAGCTCCAGCCATGTGTCTGCACCAGCCACCAGCACCCTGCCTGTGCTG<br>GCTCCTGGACCTCCACAGGCTGTGGCTCCACCAGCCCCTAAACCTACACAGGCCGG<br>CGAGGGCACACTGTCTGAAGCTCTGCAGCTCAGTCAGCTGCAGTTCGACGAGGATCTG<br>GGAGCCCTGCTGGGAAACACAGCACCGATCCTGCCTGTTTCACCGACCTGGCCAGCG<br>TGGACAACAGCAGTCTCCAGCAGCTGCTGCAGCACATCCCTGTGCCCCTCA<br>CACCACCGAGCCCATGCTGATGGAATACCCCGAGGCCATCACCCGCTCCTGACA<br>GGCCTCAGAGGCCTCCTGATCCAGCTCTCAGCTCTGGGAGCACCAGGCCTGCC<br>TAATGACCTGCTGTCTGGCGACGAGACTTCAGCTCTATCGCCGATATGGATTTCT<br>CAGCCTGCTGGCTGCGAGCCGCAGCTGGATCCCAGCCACTGGACTCCAGCAGTGACT<br>CCGAAGCCTGAGGCCGGCTCCGCTATTAGTGACGTGTTTGAGGGCCGAGTGT<br>GCCAGCCAAAACGAATCCGGCCATTTCATCCTCCAGGAAGTCCATGGGCCAACCG<br>CCCACTCCCCGCCAGCTCCGCCACACAACCAACCGGTCCAGTACATGAGCCAGTCG<br>GGTCACTGACCCCCGCACCAGTCCCTGGCACTGGATCCGATCCAGCCGCCAGTGACT<br>CCCGAGGGCCAGTCACTGTTGGAGAGATCCCGATGAGAAGAGCAGGCTGTCA<br>AAGCCCTTCGGGAGATGGCCGATACTGTGATTCCCCAGAAGGAAGAGCTGCAAT<br>CTGTGGCCAAATGAGACCTTTCCCATCCGCCCCAAGGGGCCATCTGGATGAGCTGA<br>CAACCACACTTGAGTCCATGACCGAGGATCTGAACCTGACTCACCCCTGACCCCG<br>GAATTGAACGAGATTCGGATACCTTCCTGAACGACGAGTGCCTCTTGACATGCCAT<br>GCATATCAGCACAGGACTGTCCATCTTCGACACATCTCTGTTTTTAAACTAGTaataaaa<br>gatctttatttcattagatctgtgtgttggttttttgtgtg |
| SEQ ID NO: 354 | | gggaggaagcctcaactaactacaatgactgtaagatcaatgactgggaatggtaacatatttgaagtgtctgttgacataagaatcatg<br>atattaatgcccatgcaatactcagagagaatgaaagggcgatcaacactgttgaaaggggaattgtagagcacagatgtgtcgtgtggcagtgt<br>gctgctcctagcaatactcagagagagaagaacaatgaaattctgattggcccagtggcccagatgaggttcagctgccaactt<br>tcttcacatcttatgaaagtcatttaagcacacaactaacttttttttttttttttgagacagagtcttgctctgagcccgagacagagtgc<br>agtatgactcaatcctcggctacgcagcctccgaggctcaacgtcctccaagtagctcccaggacgtgctgcaggctgaattacag<br>gagtggccaccatgcccagctacttagtatttttaatagatacgggggtttcaccatatgcccactactggtgtcagcagcctgacctcccga<br>agtgatccacctgcctcggcctccaaatgtgtggattatagcgtcagcagcacaaaaacggacgggcctccgctgaaccagtgaggcccaagatgc<br>aaaaatgtattcacatataactagtattattaatccacacaagcacgtaaatgaggaggccatagcagaaagggacgc<br>gcataaataacccctcgcgggcactggtagctgggcaaggtcggtactttgatggggccagggtgaggtcaagggcgt<br>gggtcattctcctcccgggcactggtagctgtggccaggtcgtgtctttgatgggccagggtgaggtcaagggaggaagcgtc<br>gcaggtcacagatctggattactcataagacctttttttcctccggggcaaaacgtgagtggattcagctgccaactttcccgcgatcc<br>ttgagtacgttctggattactcataagacctttttttcctccggggcaaaacgtggagtggattaatcgcccatcaagctccaga<br>ggcggtcagcccgcccactctgcccccgcctccagcccgtgagcgtcccgagcaggcgtcgagattacgcctgtcagggccgagctcgtgcga<br>gggcccctcccactctgccccccgcctcccagcccgtgagcgtcgaggccagattacgcctgtcagggccgagctcgtgcga<br>gagggaactagcagaagaagaacaggcagccgggaggtgacgcgggcagattacgcctgtcagggccgaggtgggtaagctagcgaccactcgactctggac<br>gccaaccggctttccagccccagcagcggagtgcccggctgcgtgcgagagcgaggtgggtaagctagcgaccactcgacttcccagc<br>gagtgtttctgccccagcgccgaaggcgctactagaggaacggtaaccgtgtacttttccaggggcctgtgaccccgtgccagagtt<br>gctgcgactgcgcggggctagagtgcaagtgcaagtaaggtgactggacttctctggccagtcctctactaccaggggaattagccagacacaacacg<br>cttttcccctctacccctgtctccaccaaagtcccagtcccgacgccctccagtcgcctcctttcgcctttcccctcttgtcttccgagcggatctt<br>gaaccagaccaaccgacatgccccggtgtctcaccaaagtcccagtcctccgtgcgccctccccgtgtcgaggcagtcctgtcttccgagcggatctt<br>caagggagcctccgtgccccggctgtcagtccccgtgtcagtccccggtgtgcaggaccccgaagcctcccgaagtcctgtcttccgagcggatctt</td> |

TABLE 16-continued

Nucleic acid sequences of exemplary eTFs disclosed herein that can upregulate SCN1A expression

| eTF Protein SEQ ID NO: | Nucleic Acid SEQ ID NO: | Nucleic Acid Sequence |
|---|---|---|
| | | cagcctgtttctgcgcgaccagtcgaggactcctggacagtagaggccccggacgaccgagctgGAATTCGCCACCA<br>TGGCCCAAAGAAGAAGCGGAAGGTCGGTATCCAGGAGTCCCAGCCCCTCGA<br>ACCAGGTGAAAAACCTTACAAATGTCCTGAATGTGGAAATCATTCAGTCGCAGC<br>GACAACCTGGTGAGACATCAACGCACCCATACAGGAGAGAAAACCTTATAAATGTC<br>CAGAATGTGGAAAGTCCTTCTCACGAGAGGATAACTTGCACACTTATCAACGAAC<br>ACATACTGGTGAAAAACCATACAAGTGTCCCGAATGTGGTAAAAGTTTTTAGCCGG<br>AGCGATGAACTTGTCCGACACAACGAACCATACAGGCGAGAAGCCTTACAAAT<br>GTCCCGAGTGTGGCCAAGAGCTTCTCACAATCAGGGAATCTGACTCAAG<br>AACTCATACCGGGAAAAACCTTACAAGTGTCCAGAGTGTGGGAAGAGCTTTTC<br>ACAAGTGGACATCTGGTACCGCCACCAGAGGACATATCAGGGGAGAAGCCCTACA<br>AATGCCCGAATGCGGTAAAAGTTTCTCAGAATAGTACCCTGGACACCA<br>GCGAACACACACTGGGAAAAAAAACGAGTAAAAGGCCGGCCGGCCCAGAAAAAGGC<br>CGGCCAGGCAAAAGAAGAAAAAGGGATCCTACCCATACGACTACCAGATTACGCT<br>CTCGAGGACGCGCTGGACGATTTCGATCTCGACATGCTCGGGTTCTGATGCCCTCGA<br>TGACTTTGACCTGGATATGTTGGGAGCCCATTGGATGACTTTGATCTGGACA<br>TGCTCGGCTCCGATCTCTGGACGATTTCGATCTCGATATGTTATAAACTAGTaaaga<br>gaccggttcactgtgacagtaaaagagaccggttcactgtgagaatgaaaagaccggttcactgtgatcggaaaagaccggttcac<br>tgtgagcggcctgaaaccagcagacaatgtagctcagtagagaaaccagcagacaatgtagctgaatggaaaccagcagacaatgt<br>agcttcggagaaaccagcagacaatgtagctcAAGCTTGGGTGCATCCCTGACCCCTCCAGTG<br>CCTCTCCTGCCCCTGGAAGTTGCCACTCCAGTGTCTTCTATAATTATGGGTGGAG<br>ATTAAGTTGCATCATTTTGTCTGACTAGTGTCTTCTATAATTATGGGTGGAG<br>GGGGTGGTATGGAGCAAGGGCAAGTTGGGAAGACAACCTGTAGGGCTGCGG<br>GTCTATTGGGACCAAGCTGGAGTGGCAGTGGCACAATCTGGCTCACTGCAATCT<br>CCGCCTCCTGGGTTCAAGCGATTCTCCTGCAGTCCTCCCGAGTTGTGGATTCC<br>AGGCATGCATGACCAGGCTGGTCTCCAACTCCTAATCTCCAGTGATCTACCACCTTG<br>ACCATATTGCCAGGCTGGTCTGGGATTACAGGCGTGAACCACTGCTCCCTGCCTT<br>GCCTCCCAAATTGCTGGGATTACAGGCGTGAACCACTGCTCCCTGTCCTT |
| SEQ ID NO: 308 | SEQ ID NO: 355 | ggaggaagccatcaactaaactacaatgactgtaagatacaaaattggaatggtaacatatttgaagctgttgacataagaatcatg<br>atattaatgcccatgcaataactcaggaatgaaaatgggcatcaacactgtttgaaaaggggaaatgtagagcacagatgtcgtggcagtgt<br>gctgctccacagatctgcaataactcaggagagagaacaatgaaatctgattggcccatggcctctgaggttcagctgcaacttt<br>ctcttcacatcttatgaagtcactctggctcactgacctcagcgcagctcccaacggtcctcctcgcacagccctcccaggacagagtgc<br>agtagtgactcaatctcggctcactgacctcagcgcagctccccaaccggtcctcctcgcacagccctcccaagtagctggaattacag<br>gagtggccaccacatgcccaggctaattttgtatttttaatagatacggggttcaactcaccacctcgccaacccgctgtctgcaacctcctggcctca<br>agtgatccgcctgcctcggcctcccaaagtgctggattatatggcgtcagccacactgcccgcctcggcccaccatgccccagctgc<br>gcataaattgtattcacatatactagtatttcattattatcccaacaaaacggggcctcgaccaagcagtgaggcccagagactgc<br>gggtccttttctgccgtgctgcaccaccctggtagctgtgccagttgtgtactttgatgggcccaggctgagctcaaggaagcgtc<br>gcaggtcacagatccgggaaaacccggggaaaccgtatgcggggcaaaaccgcctgcctctctacaatatatggggggagg<br>ttgagtacgttcggattactcataagaccttatttttcttccgggcaaaacggacctagctgcccgctagctgccccgactagtcgccccgatcc<br>ggcgtcaggcaccgcaggaggcagtgaggtgacgccggcctgcccaggggcagattaccctgcaggcgcaggaatgcgctg<br>ggtcccgcctccactgcccccgctaccccggagccggtgacggccgggcagattacgcctgcaggcgcgagcggaactgggctg<br>gcgtcgagggtgcaggaagtgggggagtgccgctgcgtcgcagagccgaggtgggtaagctcccatcccagccccatccagactcccag<br>gccaaccggcttttcagcaggtcctctcccccgccgtttcaaccaaccccattccaggcgcggccaccccaacctccccgaaat |

TABLE 16-continued

Nucleic acid sequences of exemplary eTFs disclosed herein that can upregulate SCN1A expression

| eTF Protein SEQ ID NO: | Nucleic Acid SEQ ID NO: | Nucleic Acid Sequence |
|---|---|---|
| | | gagtgctcctgcccagcagccgaaggcgctactaggaacgctaaactgtagtgtaccgtgccgagtt gctgcgactgcgcgcggcgccggggctagagtgaaggtgactggtgagctctctggccaagtccgagggagaacgtaaagatatgggc cttaccccctccacctgtctccaaagtcccaggatactcctaccaaagtgcctctactaccaggaaattagcacgacaacaacg gaaccagacaccgaaccagaacatgccccgcgccccgtgcgcccccgtgcctgcctcctccctcctgtcctccagaccgatctt caaggggagcctcctgcctcgctcagtcctccgtgcagtcgaggactcgaagacgtagaggcccggacgaccgagctgCTTCTCTTTg TGGCCCCAAAGAAGAGCGGAAGGTCGGTATCCAGGAGTCCCAGCAGCCCTGA ACCAGGTGAAAAACCTTACAAATGTCCTGAATGTGGGAAATCATTCAGTCGCAGC GACAACCTGTGAGACATCAACGACCCATACAGGAGAGAAAAACTTATAAATGTC CAGAATGTGGAAAGTCCTTCTCACGAGGATAACTTGCACACTCATCAACGAAC ACATACTGGTGAAAAACCATACAAGTGTCCGAATGTGGTAAAAGTTTTAGCCGG AGCGATGAACTTGTCCGACACAGCAACCATACAGGCCGAGAAGCCTTACAAAT GTCCCGAGTGTGGCAAGAGCTTCTCACAATTCACAAGTGTCCAGAGTGTGGGAAGAGCTTTTCC ACAAGTGGACATCTGTACGCCACAGAGACACATACAAGGGGAGAAGCCTACA AATGCCCCGAATGCGGTAAAAGTTTCTCTCAGAATAGTACCCTGACCGAACACCA GCGAACACACACTGGAAAAAAAGAGTAAAAACGAGTAAAAGCCGGCGACCGAAAAAGGC CGGCCAGGCAAAAAAAGGATCCTACCCATACGACGTACCAGATTACGCT CTCGAGGACGCCGTGGACGATTTCGATCTCGACATGCTGGGTTCTGATGCCCTCGA TGACTTTGACCTGGATATGTTGGGAAGCGACGCATTGGGATGACTTTGATCTGGACA TGCTCGGCTCCGATGCTCTGGACAGATTTCGATCTCGATATGTTATAAACTAGTAAG CTTGGGTGGCCATCCCTGTGACCCCCCTGTCCTTAATAAAATTAAGTTGCATCATTTTGTCTGA CACTCCAGTGCCCACCAGCCTTCTCCAGCCTGTGCATCCGGGTGTATGGAGCAAGGG CTAGTGTCTTCTTATAATTATGGCGTCTAGGGCCTGCGGGGTCTATTGGAACCAAGCTGAA CAAGTTGGAAGACAACCTGTAGGGCCTGCGGGGTCTATTGGAACCAAGCTGAA GTGCAGTGCCACAATTCTTGCCTCACTGCAATCTCCGCCTCCGCCTCTGGGTTCAAGCGATT CTCCTGCCTCAGCCTCCCGAGTTGTTGGCAGGACCATGCATGACCAGGCTCAG CTAATTTTGTTTTTTTTTGTAGAGACGGGGTTTCACCATATTGGCAGGCTGGTCTC CAACTCCTAATCTCAGGTGATCTACCCACCTTGGCCTCCCAAATTGCTGGGATTAC AGGCGTGAACCACTGCTCCCTTCCCTGTCCTT |
| SEQ ID NO: 313 | SEQ ID NO: 356 | ggaggaagccatcaactaaactacaatgactgactgtaagatacaaaattggaatggtaacatatttgaagactgttgactaaagaatcatg atattaatgcccatgcaatactcagagaagaagaacaaatgaaaattctgattggcccagtggccccagtgaggttcagctgccaactt gctgtctctcagcaatactcagagaagaagaacaaatgaaaattctgattggcccagtggccccagtgaggttcagctgccaactt ctcttcacatctcatgaaagtcattaagcacacatctcctaggctcaacgtcctcctgcactagcagaggtctgctcgagcccaggacagagtgc agtagtgactcaatctgggccctcactgagctcagtctcaggctcactatagataggggtttcaccatcaccccaggctcatagctagctggcctca gagtggccccatgccctgcagtcttagtatttttaatagatataggcgtcagccactacaaaacggacgggcctccgctgaaccagtgaggcccccagacgtgc agtgatcaactcggctcggctcccaaatgctggattataggcgtcagccactacaaaacggacgggcctccgctgaaccagtgaggcccccagacgtgc aaaaaattggtatttcacatactagtattttatccacacaaacggacgggcctccgctgaaccagtgaggcccccagacgtgc gcataaataaccctgtctgccaccctgggagagaaggggagggaccactgaggaccccgtaaatggagcggcccaagagctaggcaagaagcgtcc gggccctttactctgcgggtgcactgggcagctgtgacccaggttggctactgtttgagtgggcccaggcctctgactatatgggaggggaggg gcagggtcacagatctggggggaaccccggggaaaagcactgaggcaaaaccgcctgtctcctacacatatatgcgagggaggg ttgagtacgttctggattactcataagaccttttttttttttccctccggggcaaacccgaggctgcccccgagctagctgccccgagggcctgattatattaatgcccctataaaagctccaga gtcgtcaggcacctgcaggagagccccgcgcactctgtgcccccgacttgaccagcagtgccccgagctaggccctcgtgattccccgcgatcc ggtcccgccgcctccccactcgccccccgactccgccccccgccccgcgagcccgtgcagccgccgtccgaatctctctccgaatctctctctccgcggctgcga |

TABLE 16-continued

Nucleic acid sequences of exemplary eTFs disclosed herein that can upregulate SCN1A expression

| eTF Protein SEQ ID NO: | Nucleic Acid SEQ ID NO: | Nucleic Acid Sequence |
|---|---|---|
| 314 | 357 | gaggaactagcgagcgagaacgaggaagcagtcggaggtgacgccgggcagattacgcctcaggccgagcggatcgtgg<br>gcgctgtgcagaggaaggcggagtgggcctgctgcttcagcagccgaggcaccctggacttcccagc<br>gccaacgcgggctttcagccagtgctcctccctccgccgcggctgttacttttccaggcgcgaccctcccgaaat<br>gagtgcttcctgcccaagcgctactaggaaacgtgactggacttctctggccagtcgaggagaacgtaaagatatgggc<br>gctgcgactgcgcgcggggctagagtcaccaaagtccctagtcccgagcagtagcctctactaactagccacacaacacg<br>cttaccccctctcacctgtctcaccaaagtccctagtcccgagcagtagcctctactaactagccacacaacacg<br>ggaaccagcaaccgcgaaccgacccgtccgcccgtcccctttgtcttccagacccgatctt<br>caagggagcctccgtgccccgtgtcagtcgtgtcaggacccctcgacaggccctccgacagctctcgttcctttg<br>cagctgtttctgcgccgaccagtcgaggactctgatgtccccgtgcagatctcgtgacccgtctggatctcctcactcgccactggatgaa<br>TGGCcgcgcgcaaggccgagatgcagccgtatgtccccagtgtcggccactcctgccgagcagccacgatcgccc<br>caactacccaagctggaggagatgatgcctgccagtgctcctcggcgacgctctcggccgccaagggcagcg<br>gcagcaacagcagcagcagcgggtcggtggagcggcacctcagagcttactgaatcttctgaacacgaagaagtg<br>caacccaggcggacagtaccccagccaaacactgactgcccccatcacctggacctgccgcttacctgagctgcaccaacagt<br>ctggagaccagttaccccagccaaacactgactgcccccatcacctggacctgccgcttacctgagctgcaccaacagt<br>ggcaacacctgtgcccgagcccttcagctggcgagcccatgagcatgaccaacagccctctcgtcctcagcacc<br>atcccagcgcctctccgctccagagccctccgagccgcgcagtgcgcagtgacagcagtccattactcag<br>cggaccccacctcccacgccaactgacattaccctgagccacaaagccagccttcccgggtcggcaggacagcgctcca<br>gtaccccgctcctcgctacctgccccaagggtggcctcaggacgctgatccccagcctgcctgatccccgggatct<br>gggctcggacccccacagaagccttccagggctgaaggctccagctccgatctccagcgtcaaaccagccatgcgcaa<br>gtacccaaccggccagaagccccagaagacgccccccaacaggccctcactgccagtggctctgtcgccgcttctcccGCA<br>GCGACAACCTGGTGAGAcacatccgcatccacacacaggccagaagccttccagtgccgcatcgAGAaacttc<br>agcCGAGAGATAACTTGCACACTcacatccgcaccaccaggcgaaaagccctccgctgacattcgtgtga<br>agaagttgccCGGAGCGATGAACTTGTCGacatcgaggaaggaaccccttacgcttg<br>cccagtggagtcctgtgatcgccgcttccCAATCAGGGAATCTGACTGAGcacatccgcatccacagccag<br>aagccttccagtgccgcatctgatgAGAaacttcagcACAAGTGACATCTGTACCGcacatccgccac<br>aaggcgaaagccttccgtcgcggacatctgtgaagaagttgccCAGAATAGTACCCTGACCGAAcatacca<br>agatcccagtccaactgcgcagaggacaaaagtgagcgCTAGCtcgcaacctcatccccgtgccacctcatcctctc<br>cggttgctactctttaccctgacccatccccctgtgcacagtggcttccctccccgcggtgccaacgactccctgacccctgcttccc<br>tccggctctcctgacctaccatccctgcagctgcaccaactcctgcacagggcttccgacatgacacgcaacccttactcc<br>cggccaggtcagcagtcctccctcctcagctgcaaACTAGTaataaagatcttttcattagactctgtgaggttttagtgtg |
| | 357 | gggaggaagcatcaactaactacaatgactgtaagatacaaattggaatggtaacatatttgaagacttgacataagaatcatg<br>atattaatgcccatgaaatgaaaggcgatcaacactatggttgaaaaggggaaaattgtagagcacagatgtgtgggcagtgt<br>gctgcttcagcaataactcagagagagagagaaacaatgaaaatctgatgccagtgagtccgatgagttcagctgccaacttt<br>ctcttcacatcttatgaagtcattaagcacaacaactaacttttcattttatttttattttttttgagacagagtctgctctgagccaggacgagtgc<br>agtagtgactcaatctggctcactgcgccagctcagctagagtttaatagatacggggttcaccatatcaccaggctgaactctggcctca<br>agtgatccacccactgccccagctaatttagtatttttaatagatacggggtttcagccactatgccaccaaacaaccgggctcgaactcctggcctca<br>aaaaattgtatttcacatatactagtatttacattcatttatccacaaaaccgtaaatggagcgagcgcatagcaaagggacgc<br>gcataaataaccctgctgctgccacctgggagagggaggaccacgtaatggggcaggcttgatgggccaaggagcgtc<br>gggcctttactctgcgggtcggcactgggtagctgtggcagtgggcaggctgtggtacttttgatgggccaaggaggagtc<br>ggcttcacagatctgggggaacccccgggggaaagactactgagcaaaaccgcctgtctctacaatatatggagggagg<br>ttgagtacgttctgattactcatagaacctatatttcctccggggcaaaccgtagctgattgattatatgcccctataagctccaga |

TABLE 16-continued

Nucleic acid sequences of exemplary eTFs disclosed herein that can upregulate SCN1A expression

| eTF Protein SEQ ID NO: | Nucleic Acid SEQ ID NO: | Nucleic Acid Sequence |
|---|---|---|
| 315 | | ggcggtcaggcacctgcaggaggagccccgcgtccgcgactagtcgccccgagcaagcgcctgtgattcccgcgatcc gtccccgcctcccccactctgccccgtaccccggaagctgccagccgctcgaatctctcttcctggctcggcgtgcga gaggaactagcgagaacgagcagtcgccgagcgagctcaggccgtcaggccgagcggatcgctgg gcgctgtgcagaggaaagggggatgccggctcctctcccgcgggctcgtgtcgcagagccgagttggtaagctagcgacaccttcccagc gccaacctggctttcagccagcacggtaactgttacttaccagggccgtagtgaccgtgccgagt gctgtcctcgccccagagccgaaggcgctactaggaacggtcaaccttgttacttaccagggccgtagtgaccgtgccgagt gctgtgacgcgccgggggcgcaagtgcgcaagtgcaagtctctggcaaggaggaacctaaagatatgggc ctttaccccctcacctgtctcaccaaagtccctagtcccggagcagttagctctcataccaggagaatagctacacaacacg gaaccagacaaccagacatgccccgcgcgcagccctccccctgttcctccctgtctccacagctctgctttccttg caagggagcctccgtgccccgctgccagtcccctccgtgtgcaggacccccaacaccctcccgcgccgtcgctcgccgagtcctccccgccgcgtcctcgcgccttttg cagctgtttcgccccggaccagtcggaccagtgcccggaccgtctggtccgccgtcgcgcccatggggctccgcccgcccatcccgccccatccCA TGGCcgtccgaccacctgatctcgccgggcccggcgcctgacacgtgggctgagccggctggtccgcgcccgcgcc cgctcccgactctgcgccgtacgcggcagcgccggggccctctgggcggcctcctccagccccgccctgccctgccctgccctgccctgccctgccctgccctggc ccccccaaccggggcctgcagctgtgcgagctggtgcgcctgggagcccaagctggcccaagctggcgaccgcgaccggagagcctgcagagcctgcagacgcgcagcgagagg gccccggccaagcgccagcccgcgccccgcgcccggcgaagtgcggcgccgagctgccgagcggcatgacgcgcgaactcatcgacgaggg cgcgacgctgggtgaactccggcctcgtgctcctgagctcgcgtcgggcgccgactcctggtgttctggtcagtccagctcatcaaaccca ctcggactgggtccgccgcccggtcccgctgaagaacgaaccgccccccaacggaacgccccaacggagccccccaacggacccccc gctgatgcaagtaccccaaccgcgcagcgggcatcccgaagaccccaagtaccccaaccggagccccccaacgcagccccccaacgcagcggcgc gctctccCGAGCGACAACCTGGTGAGAcacatcgcatccgcataccccttacgctcgcagcgccgcgttcagtgccatctg catgAGAacttcagcCGAGAGGATAACTTGCACACTCcactatccgcaccccaacaaggcgaaaagcccttcgcct gcgacatctgtggaagaaagttgccCGGAGCGATGAACTTGTCCGAcatacccaagatccaactcgcgcagaagga ccagctcttagcttccccagtggagtcctgtgatcgccccttcccCAATCAGGAATCTGACTGAGcacatccgcat ccacacaggccagaagccccaagtgccgatcatgAGAacttcagACAAGTGACATCTGGTACGCc acatccgcaccaagatccacttgccgcgcagaaggacaagTCGAcatgccgaccaccgatgctgccgagggctaccgc tggtccagaggccgcgcgcatcccgtcgcgcagcgccatcccgtcgctgccctgccgacccgggctgcccgcgtgggcctgac agtggctgagcgccgggccccaaccgtcgggccccaacccgtctaccggggcctctgcggcg cgggcgccgcccaaccgctccggaaggccccccaaaccgtctccggaaggccccccaaccgtcctgaccaagcgccagcccgccgtaccccgccgcccgcgcg ggcgagctgccccagctggcggccgagacgccgagctgacgtctctcgactgcttctccggccgctcgccctggctgtcccgactcgcgccgccgtctgctgggggacctggggcagcgccagtgtg ctaaACTAGTaataaaagatctttatttcattagatctgtgtgaggttagtgtg |
| 358 | | ggaggaagcatcactaactacaatgactgtaagatacaaattggaatggtaacatatttgaagactgttgacataagaatcatg atattaatgccatagcaactgaaatggcatcaacactagtttggaaaaggggaaattgtaagacagatgtgtttgtggcagtgt gctgtctctagcaatactcagaagagagaaacaatgaaatctgatggccagtggctgaagttcagctgccaactt ctctttcacatcttatgaaagtcattttaagcacaactaacttttttattttcactgctgtgtgctgtcagtagagacagagtgc agtagtgactcaatctcgctcatgacgctccatcagctccgcatcagctcccaagtagctgaattacag gagtgtcaactgccagtccagtcctggctccaaagtgcattttaatagatagggtttccacatatcccagtcggtcttcggcctca agtggtcaactgctggcctccaaaggtggattatggggtccgccaactatgccccgtgaaccagtgaggcccagacgtgc aaaaattgtattcacatactagttatacattttatctacacacaaaacggacggggcctccgttgaaccagtgaaccgtgaaaagggacgc gcataaataaccctgcgtgccaccctgggagagggggaggaacacgtaaatggagcgagcgcatagcaaagggacgc gccctacctgcgcgtgcactgggtagctgtggcaggtgtggcctactttgatggggtcttaaggctgagctcagggaaggcgtc gcagggtcacagatctgggggaaccccggggaaaagcactgaggcaaaaccgccgctcgtcctcctacacatatatgggaggggagg |

TABLE 16-continued

Nucleic acid sequences of exemplary eTFs disclosed herein that can upregulate SCN1A expression

| eTF Protein SEQ ID NO: | Nucleic Acid SEQ ID NO: | Nucleic Acid Sequence |
|---|---|---|
| SEQ ID NO: 316 | | ttgagtacgtctcggattactcataagacctatattttcctccgggcgcaaaccgtgagctggattataatcgccctataagctccaga ggcgtcaggcacctgcaggagcccccgcttccgcgactagctgccccgactgccccgagcaacggctgctgtgatttcccgccgatcc ggtccccgctccccccactgcccccccgccctccccaccccgagcgtggcagctggagttacgccgggcagctgcctctcctggctgcgtgcga gagggaactagcgagaagcgggagtgccggttcgctgcgagagccgaggtggtaagctagcgccaccctggatctcccagc gcgtgtgcagagaaaggcggagttcagccagtcctctctccccgggcttctcaacaaccccatccccaacctcccgagcttcccgaaat gagtctctctgcccccagccgcagccgcgaaatcctaggaacgctgtctgaacctgtagtccgccctgtagtccgcccagtt gctgtgcgactgcgcgggctagagtgcaagtgactgtgcccccgagcagctgcctagcctactaccaggagcagttagccagacacaacg cttaccccctctcacctgtctcaccaaagtccctagtcccccgcgcgctccccgcgtcccgtgcctggtcgcctccctgtctcccagaccggatctt caaggaggcctccctggcgccaggttcggtctcgccgcgccgcgttcaccctccggtcccccgcagagccccgacagctggcagcagcagcact cagcctgttctgcgccggaccagtcggactctgaacgcgagactcgaagcgccccgacgacgaccgagagtcgaattcgccacca TGGccggccaaggccgagatgcagctgatgtgctgcaacgggtctccagtcctcggcgcgcggggcctcagaggcagcg caataccccaagctggagaggagtatgtgctggcagggggcggtggaaggtgtcgcacgaggaccaacggcagcagcacctt gcagcaacagcagcaggacaggcaggaggccctacgaggacaacacctactgcgtttacctgacatcctgaacaacagagaagtg ctgtggagccagttacccccagcagcccctcttcagcttggtcagtcgagccgcagtagcgagcctcctgcctcagcacc ggcaacactgtcgcccaggcccatccaacgacctgagtgcctagtgacatgacacaacagcagtccattactcag atctccgggctccccaccgcgactactacccgaccaaagcaggcctcggtgctgcatccgcaatgaccacaagagcctctgtctcagagcgctcca gcacccaccacctccctgcgtcctccgaaccttcccatctggctgctcctgccttcccagcccccgacttactcgcagcaggatct gggtctggcacaccagaacagaagcccttccaggcctggaagagcccagcacgcttgctaaccctcatcaaaaccagcacgcgcaa gcccttgccactcagctggctcccccggaagcgcctaataccagcacaagcctccccagtcgcctgccagtcctgtgatcgccgcgcatgcgcaa gtacccaacggccaagagcccccgcgatcacccgacgagccctccagtgccgcatctgccctgccatctgatgAGAaactc CAGACAACCTCGTTCGAacatccgcatccacacaggccagaagcccttccagtcgccgcatgAGAaacttcagcCAGTCTAGCTCACT agcCACCGGACTACTCACGAAcacatccgactactccatactccaccgggcaccccttccagtcgccgacatcgtgccCAGGAGGA agaaagtttgcCAGAGAAGACAATTCCATACTCACATCCGGACACACACGGAGAGA GCCATTCGCATGGATATATGTGGGAGAAAGTTCTCCACAGCCATTCTCTCACTGA AcacatccgcatcccacaaggccagaagcccttcagtcgccgcatctgccgacatctgccgcgacatcgtggaagaaagttgccAGGGAGGA GGTGAGGcacatccgcaaccacaccacaaagatccacttgccgcagaagacaagcagacaagcattgagtgGCTAGCtcgg TAACCTGCATACGCataccaagatccacttgcctcctaccccgtgctacttctaccctatccccggccaccaccctcata ccacctccccttctccctctcctaccccgtgctacttctaccctatccccggccaccaccctcgtgcca ccagtactcctgacccccctgttccccggccccagtcagcagttccctccctcagcaactcctcagcgcctccacaggg cttggacatgacaagcaacccttactccgctcaaaacaatgttgcaaattgctaaACTAGTaataaaaatctttatttcattagatcttgtgtt ggtttttgtgtg |
| SEQ ID NO: 359 | | ggaggaagccatcaactaaactaactgactgtaagatacaaattggaatgtaacatatttgaagactgttgacataagaatcatg atattaatgcccatgaaatgaaaggggcatcaacactatggttgaaaaggggaaattgtagagcacagatgtcgtggcagtgt gctgcttcagcaatactcagagagagagaacaatgaaattctgattgggcccgatggtcagctgcactttt ctcttcacatcttatgaagtcattaagcacaacttaacttttatttttattttttgagacagagtcttgctctgagccaggacagagtgc agtagtgactcaatctcggctcactgcccagctcagtttgtattttaatagatacgggtttcaccatataccccggcctccaggctcctca agtggccaccacctgcccccagctggccctggattataggcgtcagccactacgggccccactgttcgaacctgggatctcagcctca aaaaattggtatttcacatatactagtatttacatttatccacacaaaacggacgggctccgctgaacagtgcccagacgtgc |

TABLE 16-continued

Nucleic acid sequences of exemplary eTFs disclosed herein that can upregulate SCN1A expression

| eTF Protein SEQ ID NO: | Nucleic Acid SEQ ID NO: | Nucleic Acid Sequence |
|---|---|---|
| SEQ ID NO: 317 | | gcataataaccctgcgtgctgccacccactgggagagggaggagcagcagcgcatagcaaagggacgc<br>gggtccttactctgccggtggcactggcagtctggccaggtgtggcacttgatgggccaaggaagcgtc<br>gcaggtcaacagatctggggaaccacttgggcaaaaacactgtggcaaagggaactgaggcctcctggggcaagcctcaggg<br>ttgagtacgttctgattactcataagacctatattttcctccgcgactagctgccccgcgaaaacgtgagctgagttatatcgccctataaagctccaga<br>gggcgtcaggcgcaacctgcagaggagccccgcgcttaccccggagccgtgcagccgctagctgccccgcgactagctgaacgctctgatttcccgcgatcc<br>gtccccgcgcaacctgccactctgcccactcttggccccggagcccgcgtcagcccctcccgaatctctcttcctctcctggcgtcgcgtgcga<br>gaggaactaccgagaaccagcagcgatgacgccagtcagcgagattacgccgctccgagccggatcgctg<br>gcgctgtcgagagggaaagggggatgccccggctgcccggctcgtcggcagccaggtggtaagctagcgacaccctggacttcccagc<br>gccaactgcgtttcagccaggtcctctctcccgcggctctcaccaaccgccggccacccaacctccgagc<br>gagtgcttcctgccccagcgcgaaggcgctataggaacgtaacctgttacttaccagggccgtcgacccgtgccgagtt<br>gctgtgcgtgcgcggcggcggccggggcaaggtgacttggaacttctccggcccagtccgaggagaaactaaagatatgggc<br>ctttacccccctcaccttgtctcaccaaagtccctagtcccggcagcagtagctctactaccaggagcttagcagcaacaacg<br>gaaccagacaccgaaccagacatgccccggctgtccccgcctcagtgccctccgtgcaggccccgagctgtctctcccagagccggatctt<br>caaggggagcctccgtgccgcccactgccctgcccagtcccgcgagccggccgtccgcgccgcccatgggctgcccggcgcc<br>cagcctgttctgccgaccagtcgggaacctcggaactcagaagtagagcgcaacgacgagctgGAATTCGCCACCA<br>TGGCCgccgacacctgatctcgcgaggctacgccggcctgacagtgggctgagcgggtctcgctgggcgcgcgc<br>cgctccggactctgcgccgtaccgcgggccgggcccagtcttcggcggccgtcctctccaagcggcccctgcctgccgggccggcccgg<br>ccgccaaccggggcgtcagcctgttggcgaccgcccacgccgtccctgctgccaacgtccggggaggcccgggcc<br>gcatcgccaccctgtcgcagcctgtggcagccgcccacgtcgggcagtgagcgcgaactcatcgacgaggagg<br>cgctgacgtcgctggagctgggcctgcccgggcctcctggtgcacccgagctgcccgagctgacctgggccagagcagtcgactgctt<br>ctcggactttggggtccgcgccgccggctccgtgagctcggtggttctggtggttctggtcagtccagcctcatcaaaccca<br>gccatgcgaagtacccccaaccggccagcaagccttcagtcgccagcccaacgccaacgaaccctcaccacagccggaccagccacgggcagcggcctctttaatcc<br>gctctcCCGCCACAACCTGGTGAGAcacatcgccagcgaagaaaagccctcgcct<br>catgAGAaacttcagcCGAGAGATAACTTGCACACTCaacatccgaccaccaggcgaaaagccctcgcct<br>gcgacatctgtggaagaaagtttgccCGAGCGATGAACTTGTCCGAcatacccaagatccacttgcgcagaagga<br>cccctttacgctgccccagtggagtcctgtgactcgccgcttctcCAATCAGGGAATCTGACTGAGcacatccgcat<br>ccacacaggccgacgaagcccttccatgcgcATAGAacttcagcACAAGTGGACATCTGGTACGCc<br>acatccgcaccaccaagatccgctgcgcagaagcccttgcgacatctgcgacagaagcaagtaaCTCGAGACTAGTaataaaagatctttattttcattagatct<br>CCGAcatacccaagatccacttgcgcagaagcagaagacaagtaaCTCGAGACTAGTaataaaagatctttattttcattagatct<br>gtgtgttggtttttgtgtg |
| SEQ ID NO: 360 | | ggaggaagcatcaactaaactacaatgactgtaagatacaaaattggaatggtaacatatttgaagagctgttgacataaagaatcatg<br>atattaatgcccatgcaatatgaaatgaaagggcatcaacaactatggtttgaaaagggaaattgtagagcacagatgtcgtgtggcagtgt<br>gctgctctcagacaatactgagagaggagaacaatgaaatcttgattggccccagtgtggccccagtgaggttcagctgccaattt<br>cttctttcaatcttatgaaagttcattagaagtcactggcctccacctcctaggctccaacgctccatcagcctccagtagtgaattacag<br>agtaggactcaatctcggctcactgaccccagctaattagtatttttaatagataccgggggttcacctatccaccagtctcgaactctggcctca<br>agtagcgcccaacatgcctgctcaccccaaagtgctggatatagcgtggaatatccccacaaaacgagggctcagcgaccaacagtgaggcccccagagtgc<br>aaaaattggtatttcacatatcactagtatttatcatttacacccacaaaacgggctcagcgaccaacagtgaggcccccagagtgc<br>gcataatacccctggtgcacccacctggcactgtcgccaccctgtaatgggccccagtgtggtacttgatgggcgtgagctcaggaagcgc<br>gggctccttactctgccggtggcactggtcgtggcaagtgtggaaagcactgaggcagcagcgcatagcaaagggacgc<br>gcaggtcaacagtctggggaaccacctgggaaaaaccaccctggcgctcctccacaatatgtgggggagg<br>ttgagtacgttctgattactcataagacctatattttcctccgcgactagctgccccgcgaaaacgtgagctgagttatatcgccctataaagctccaga<br>gggcgtcaggcgcaacctgcagaggagccccgcgcttaccccggagccgtgcagccgctagctgccccgcgactagctgaacgctctgatttcccgcgatcc |

TABLE 16-continued

Nucleic acid sequences of exemplary eTFs disclosed herein that can upregulate SCN1A expression

| eTF Protein SEQ ID NO: | Nucleic Acid SEQ ID NO: | Nucleic Acid Sequence |
|---|---|---|
| 318 | 361 | ggtcccgcctcccacttgcccccgcctaccccggagccgtgcagccgcgcctctccgaatctctctcttctcctggcgctcgcgtgcga
gggaactagcgagaacgaggaagcagctggaggtgacgccggacagattacgcctgccaggcctgagccgagcgagctgctgg
gcgtgcgcagaggaggaggggaattgcgtgcctgtgccagcctgcgcaggtggtaagcctgacagtgccgaactgccccagc
gcccaaccggcttttcagccagcccaggtgtcctccccgcgcttctcaacaccatcccagcgccggccaaccctccgaaat
gagtgcttctgcccagagcagcgaaggcgctactaggaacgctaacctgtaactctctggcaacgccggagaacgtaaagatatgggc
ctttaccccctctgtctcaccaaagtgcacaaagcctctactagcctgtatagctacactactagcagaacaacaacaacg
gaaccagacaaccagaacatgccgcccggctgccctccggtgtcagtcctcggtgcaggacccggacccagcccccgatctt
caagggagcctcctgtgcccgccgtgcgtccggaggacatagagcccggagcagaccgagtgGAATTCGCCACCA
TGGCCgccgaccacctgatgctccgccaggacgtcagcgaggaggccccggcccggcccccatgcctccatg
cgctccgacgctccgccctacgcgcgggcccctgcggacgcctccggccccctcagccgccccaacgctccggaggccgcggcccgcgcgg
cccgccaaccccgggcaccgtgcagcctcttggcgctgtgcggacccccggccgccccgtgcctcccaacgctccggaggccgccgg
gcatcgccagccgtcccaggcgccccgcgcgccgcccggcgccgcacgcgccgctgccagcccctccccccccccccccccccg
cgcagccgccgcgaggaggcggcgtggatggagcctggcgtgggggcgcctcgagcctgcccagcgcagagccagcgagttcgactgctt
ctcggactgggtccgcgcgccgcgccggtctccgtgagctccgtgactgtggtgtctggtcagtcccagctcatcaaaccca
gctgcatgcaagtaccccaacggcaaggacacccgcagcccaagccagcccagccccagaagccctacgcttgccagtggagtcctgtgatcgcc
gctctccCGCTCAGACAACCTCGTTCGAcaactcccgatctccgaccacaggcggaaaagccttcgctg
atgAGAaactcagcCACCGACTACACTCACGAAcacactccgacccagcaaggcaaccgcccatctg
cgacatctggaagaaagttgccAGAGAAGACAATCTCCATACAtcataccagatccctgcgcagaggac
cgccttacgctgcccagtggagctcctgtgactcccgcatctcgatgcgccgtttctcACCAGCCATTCTCTCACTGAAcacatccgcatcc
acacaggccagaaagccctctccagtgccgatcttcgccgcatgAGAaacttccgcCAGTCTAGCTCACTGGTGAGGcac
atccgccacacaggccaaagacctctccgccctccgcgccagccgcaccctgattgccAGGGAGGATAACCTGCAT
ACGcataccaaagatccccttcggcagaagaacaagCTCGAGatggcgacaccaccctgatgctcgcagggctaccgctgg
tgcagaggcgcgctccggccgccgcgccgccatgccccgcgccgactctgccgcgccgacctgcgccgggcctccgggccg
gggctgaggccgcggaggacgccgcgcctccgtgggggtccgtgggggcccccaagccgtaccgctccaaccccgggcccctgg
tctccttccgcgcctcccgccgggcgcacccgcaccctcgcgccaccctgccggccgccccacccccgggcgccgccgcgccccggccgcg
cgggccgcgccaaccggtcccggagggaggccgccaagcctcccggaagcgcagccccagcgcagcgccgcggggctgaccgcgcccg
gccctgggccgcatgcggaaccctgctcccgcgcagcccgagctgcgccgatcctcccggactgggggctggccgcctccccggccgcg
agctgccgccgtgacctggcccagacgggcgcttccggactcctggggggtcctccgcccggccccgtgagctgctaa
ACTAGTaataaagatcttattcattagatcgtgaggttagtgtg |
| 361 | | ggaggaagcatcaactaaactacaatgactgtaagatacaaattggaatgaaatattttgaagactgttgacataagaatcatg
atattaatgccatgaaatgaaaggggcgatcaacactatgtttgaaaagggggaaattgtagagcacagatgtcgtgtgcagtgt
gctgctctagcaatactcagaagagagaacaatgaaatctgatttgccccagatgaggtttagctgccaacttt
ctcttcacatcttatgaaagtcattaagcacacaactaacttttttttttttttttgagacagagttgctctgagccaagacagagtgc
agtagtgactcaatctcggctcactgcagcctccgcctcccaaacgtcctctcgatcagctccaagtagctgaactacag
agtggccaccctgccccagctaattagtttatttattattagatatagacgggggttcagccactttgttggccaggctggtctcgaactcctga
agtgatccacccgccccggcctccccaaagttggattttatagatagccctgaccactatgccaacacaaaacggggccctcgcctgaactcctgaacaaaaatcctt
aaaaaattgatttcacatatactagtattcacatttatccacacaaaacggggaccacggtaaatggagcgagccagtgaggcatagcaaaggggcacgc
gcataaataaccctgctgctgccacctgggagagggggaggaccacggtaaatggggggtgcagctcaaggtgttgatgggcccaaggctggagctcaaggagcgtc
gggccctactctgccggtgccactggggaaccccggggaaaaagcactgaggcaaaaccgccgctcgtcctccaaataatgggggtggagg
ttgagtacgttctggattactcatgagacttttttttcccttccgcggcaaacgtgagctggattttataatcgcctataaagctccaga |

TABLE 16-continued

Nucleic acid sequences of exemplary eTFs disclosed herein that can upregulate SCN1A expression

| eTF Protein SEQ ID NO: | Nucleic Acid SEQ ID NO: | Nucleic Acid Sequence |
|---|---|---|
| | SEQ ID NO: 319 | ggcggtcaggcacctgcagaggagccccgcgtccgccgactagtcgcccccgagcaacggcctctgattcccgccgatcc gtcccgcctcccacctgccccactctgcccggagccgtgcagccgcctccgaatctctcttcctggctcgcgtgcga gaggaactagcgagaaacgaggaaagcagccgggcgccgtgaccggagccgagccgcgtgggatcgctgg gcgctgcagagggaaaggggattgccggctcctctctcccgcggctcgtcgcagagccgaggtggtaagctagcgaccaccctggacttcccagc gccaaccggctttcagccagccagtccgaaggcgctactaggaacggctaactgttactttccaggggccctagtgacccgtgcccgagtt gctgtcgcgcgggcgaggcaagtgacctgcaagtgtcaagtgtcccaggggagagaaactaaagatatgggc ctttaccccctcaccttgtctcaccaaagtcccccaggcctgcctccccgtgcgcctcgtgcctcctcctcctctcctctgagagccgaatcctt gaaccagacaccagacagtagccccgctgcccgctgtcagtgccccccgtgtgcaggagccgaccccgtgtgcaagtccctcccacacagctctgctttctttg cagcctgttcgccggaacagtggaggacgggagggcccggaccagtgggaccacgggccacgggccacctgGAATTCGCCACCA TGGCcgccgaccacctgccgccgactctgccgccgcctgcccgggcctgaccagtggctgagagccgtgagccgcgggggctccgctgggcccgcgcg ccccccaaccgggccccctgcgctacggggcccctcggcgccgcctacgggctcgggctgctgccccgccgggcc gcatgcgcgcttgcagcctgtggcagccgcgcacgcccgccgcccccgcgccgcaactcagccAGTCTAGCTCACTGTGAGGcac cgctgacgtgctgagctgagctgcccgccgctgagctgcaactctcgtcctggccagagcgagctcgactgctt ctccagactgggtccgccgcccaccggccctgccgcgccctgtgactgggtcgtcagtccagctcactcaacca gccgatgcaagtaccccaaccgggcccagcaaacggccccccccaaggaagccctactaccgtcgtggggcagcttacgcttgcagtctcagtgccgatcgcc gcttctccCCTCAGACAACCTCGTTCGAcacatccgcatccgaagcccttcccgcatctgtgcagcctcctgtgatcgcc atgAGAaacttcagcCACCGGACTACACTCACGAACcacatccgcacccacaggcgaaaagcccttcgcctg cgacatctgtggagaaagttgccAGAGAAGACAATTCCATACTcataccaagatccactgcggcagaagac cgccctaagcttgccagtcctgatcgcctgctctccCACCAGCCATTCTCTTCCACTGAAcacatccgcatcc acacaggcagaagccctcagtcgcagatcagAGAaactcagcCAGTCTAGCTCACTGTGAGGcac atccgccaccagatcccactggcgaaagccctcgcctgccgcagaaggaccaagtgcCAGGAGGATAACCTGCAT ACGataccaagatccacttgggcagaaggaccaagtgactACTCGAGACTAGTaataaaagatcttttattcattagatctgtgt gttggttttttgtgtg |
| SEQ ID NO: 362 | | ggaggaagccatcaactaaactgactgtaagatacaaattggaatggtaacatatttgaagactgttgacataagaatcatg atattaatgcccatgaaatgaaatactcagagaggagaacaaatgaaatcctgattggcccagtggctgagccccagtgatggagttcagctgcaactt ctcttcactctgcaatatctgaaagtcactggctcactgcagctcagctccaatcaactttctatttttttttttgagacagagtctgctctgagcccaggacagagtgc agtagtgactcaatctcggctcactgcccagcctcgagtggaccccagttctctgtcgcatcagcctcccagctagctggaattacag gagtggccaccatgcctgccctcccagccaggcctgggtttcaacctgcaggcctggggttcaaggcgtctgggctgtctccgaactcctggcctca aaaattgtatttcacatatactagttgcattacatttatcccaccagtgggcgtaatgagcgagcgcatagcaagggacgc gggtccttactctgccgtgtgccactggtagtgtgccaggttgtattgatgggctgagctcaaggggggagg tttgagtacgttctgattactcataagactatatttttcctttccggcgccagccgactagctgcccggcctataaagctccaga ggcgtcaggcacctgcaggagccccgcgctccccactgctgccggagctgaccgaggagcgcgtctcccgccgatcc gtccccgctccctcgccccactctgccccgcgagcgtgcagccgcctctgctgccagctgggatgtcagctcagctccccctgcgagcgtcaccgatct gaggaactagctcagctcagcgaggcagtgccgcccggagcgcgattgtcccccggcctgaacccgcaggacgctgcagctcccgac gagggaactagcgaaggcaggagtggagcggaccctcgccgccgcgagcgcaggtgcagcctctcctcgaggcctctcctcgaggcctctgagccgaggctgc gccaaccggcttttcagccagtccagaggctctcctcccgggctctctgcccggtttcaaccaactctaaccaacctcccgaaat |

TABLE 16-continued

Nucleic acid sequences of exemplary eTFs disclosed herein that can upregulate SCN1A expression

| eTF Protein SEQ ID NO: | Nucleic Acid SEQ ID NO: | Nucleic Acid Sequence |
|---|---|---|
| SEQ ID NO: 325 | | gagtgcttcctgcccagcgccgaaggcgctactaggaacgtaacctgtacttaccagggccgtagtcgaccgctgcccgagtt<br>gctgtgcgactgccggcggcgggggctagagcggaggtgactggacttctctggccaagtccaggagaacgtaaagatatgggc<br>ctttaccactcacctgtctccaaagtcgcccaagctgccgcccggaagccttactaccagggaattagcagcagcaacaacg<br>ggaaccagacaaccgaccagatctgcccgccctgcgctcccgtgctgcctcccgctgcgcttcctccctcttgtcttccagccgatctt<br>caagggagcctccgtgcccgctgcccggactcgaggactcagagtgagaggccccggaagcgaccgagtgGAATTCGCCACCA<br>TGGccgcgccagcggaatgcgaatgcgcccagagcgatgtcccggatgatctgatcgtcgatctcctcactccgccaccatgga<br>caactacccctaagctggaggagatatgctgctgagcaacggggctctgctgagcaacaggccggggcgcgcggggccccagagggcagcg<br>gcagcaacagcagcagcagcagcggggtggaggcgccctacgagccgagcccagagttccatgacatctcctgaacaacgagaaggtg<br>ctggtggagaccagtaccggcgccaaaccactcagctcctgggcagcctgtgcgctgacctgcaccccaacaccacaccaacagt<br>ggcaacacctgcgccagcctctcctccgctcagcttggtcagtggcctggtcagtgagcatgagccatgccagtggccatcagcacagagtccattactcag<br>atctccaggggcttcctcccacgccgaacactacccctgagccacaagcaggccttcccgggctcggcaggacagcgttcca<br>gtaccacctcctgccctccccacgccgaagtcctgccaaggtggcttccagttccactgatcccagaccactgtttccacagcaggggatct<br>gtgctgggaccccagacagaagcccttccaggacccccagcagccttcgtaaccctgtctactattaag<br>gcctttgccactcagtcgggctcccagaaggacctgaaggccctcaataccagtaccagtcccagctcattcaaaccagcagtgcgcaa<br>gtacccaaccggccagcaagaccgcccccaacaaggcgaaaagccctcgctgcgacatctgtgga<br>GCGACAACCTGGTGAGAcacatccgtgaggtcgcagtctgcatgagAAaacttc<br>agcCGAGAGATAACTTGCACACTcacatctgcctgcgacatctgtgga<br>agaaagttgccCGAGCGATGAACTTGTCCGAcatcaccaagatccactgcgcgcagaaggaccgccttagcttg<br>cccagtggagtcctgtgatcgccgcttctccCATTCAGGGAATCTGACTGAGcacatccgatccaccaggcag<br>aagccttcagtgcgcatctgatgAGAaacttcagcACAAGTGGACATCTGTACGCcacatcgcacccac<br>acaggcgaaaagccttcgcctgcgacatctggagaagaaagtttgccCAGAATAGTACCCTGACCGAAcatacca<br>agatccacttgcgcagaaggacaagaacagacaaaagtgagtgGCTAGCtcggccaccatcgcccaccctcatacccctgtgcccacctcctgcccactcctctcctc<br>cggttgctacctcttacccgtccccggttactacctttatccatccccgccaccaacgtactcctctgaccctgcttcc<br>cgggccaggcagcgtccccttcccagctgtcaccaactgttcgacatgacgacgacaacctactcc<br>caggacaattgaaattgctaaACTAGTAAGCTTGGTGCATCCTGTGACCCCTCTAATAAAA<br>CTCTCCTGGCCCTGAAGTTGCCACTCCAGTGCCCACTAGCCTTGCCTAATAAAA<br>TTAAGTTGCATCATTTTGTCTGACTAGGTGTCCCTTCTATATAAATTATGGGGTGAGG<br>GGGGTGGTATGGAGCAAGGGCAAGTTGGGAAGACAAACCTGTAGGGCCTGCGGG<br>GTCTATTGGGAACCAAGCTGGAGTGCAGTGCACAATCTTGGCTCACTGCAATCTC<br>CGCTCCTGGGTTCAAGCGATTCTCCTGCCTCAGCCTCCCGAGTGTTGGGATTCCA<br>GGCATGCATGACCAGGCTCAGCTAATTTTGTTTTTGTTTTGGTAGAGACGGGGTTTCA<br>CCATATTGGCCAGGCTGGTCTCAACTCCTAATCTCAGGTGATCTACCCACCTTGG<br>CCTCCCAAATTGCTGGGATTACAGGCGTGAACCACTGCTCCCTTCCCTGTCCTT |
| SEQ ID NO: 363 | | ggagaagcatcaactaactacaatgactgactgtaagatacaaatttgaatggaatgtaacatatttgaagttctgttgacataagaatcatg<br>atattaagtggcatcaaaggcgatcaacactatgggtgaaaatttgaaaagggggaaatgtagagcacagatgttcgtgtggcagtgt<br>gctgctctagcaatactcagagagagacaatgaaatctgattggcccagtgaggttcagctgcaacttt<br>ctcttcaatcttatgaaagtcattaagcacaacttaacttttttttttttttttggaacagagcttgctctgagccggacagagtgc<br>agtagtgactcaatctggctactgcagctccacccctctctaggctccaaacgtgctcctgcaaacgtagctgagtaacggaattacag<br>agtaggccccaaccaatgcccagctaattagtatttttaatgatatacgggggtttcaaccatatcacccaggtctcgaactcctggctca<br>agtgatccactgcctcggcctcggcctcccaaagtgctgggattataggcgtggattataggcgtggcagcactgcccacctggcccacctg |

TABLE 16-continued

Nucleic acid sequences of exemplary eTFs disclosed herein that can upregulate SCN1A expression

| eTF Protein SEQ ID NO: | Nucleic Acid SEQ ID NO: | Nucleic Acid Sequence |
|---|---|---|
| | | aaaaattgtatttcacatatatactagtatttacatttatccacacaaaaacggacgggcctccgcgtgaaccagtgaggcccagacgtgc<br>gcataaataaccctgctgctgcaccacctggagaggaggaccacgtaaatggagcgagcgagccatagcaaaagggacgc<br>gggcattcctctcccgagtctggcggtgtgccaggtgtggcactgtactttgatgggccagttgcaagggcccggagcagcgagcgagcgc<br>gcaggtcacagatctggggggaaccccgggcaaaccgctcgtgtctccacaatatggaggggggag<br>ttgagtacgtctcgattactcataagacctcattttttcctccgcgactagtcgccgagcaaccgctgagtggattataatcgcctataaagctccaga<br>ggcgtcaggcacctgcagaggagccccgcctcccgccgactagtcgccgcccgaatctctctccgccgctcgcgtgcga<br>gtcccgcccccctcccactccgcgagccgtgacgcagattacgcctgtcaggggccagattacgcggatcgctgg<br>gagggaactagcgagaacgaggaagcagctggagtgaccgcggcagattacgcctgtcaggggccagattacgcgggatcgctgg<br>gcgtgtgcagagagaaaggcgggaagtgcccggtcgcctgctgcagagccgaggtgggtaagctagcgccacctgagttcccagc<br>gcccaaccgggcttttcagccaggtcctttcagccaggcaagcaccccaccaacctcccgagtt<br>gagtgcttcctgcccagccgccgaaggccccggaagcgttaaccttgtactcttccaggggcgtagtcgcaccctgcccgagtt<br>gctgtgcgacgcgcggggcagagtcagagtcaaggtgactgtgactctctgccaagtctctcgccaggagctctgccagtaaagatatgggc<br>attacccctctcacctttgtctcaccaaagtcctagtccggagcagttagcctcgctgcattccctcctgtctctccagcccgatctt<br>ggaaccagacaccgaaccagacatgccgccgcctccccgcgccctccccgcgtcgtcagagtcctccccggagaaggccgagagccgagctcctgtctcttttg<br>caagggagcctccgtgccgtgccgaacatgacatctggacactgagctcggacagcgagctgacccaggcggaccagttcgcttcttttg<br>cagccgttttctgccgccgagagccgagctcgtcccgctcgagatctctgaccgtccagattcctcactgccaccagatGAATTCGCCACCA<br>TGGcgcggccaaggcgagatgcagctgtatgtcgtgcgaacgggctctccggcgcgccagagggcagcg<br>caataccctaaagtggaagagcagcagcgaggcggggcggttggaggcgcggcgagggtcgagcagcagcagcagcactt<br>gcagcaacagcagcagcagcagcgggacggtgaaggcgaccaccgccagcaccgcgggggcggcgcacagcgagaagtg<br>caacctcaggcggacagcggagcagcctacgagcgaccagcactgaccccccatcacctatactgccgattcctggagctgcaccaacagt<br>ctggtgggagcacacctgtgggccccagccctccgtagttggtcagtgcctagtgagctgcagatgcagcaagacagtccattactcag<br>ggcacacctgtgcccgaggccctccgcctcccgcctcccgaacactgacatttcctggagccacagcagtccaacagccttactagcac<br>atctccagcggctctcccaggccgaacactgacattttcctgagccacagaaccacgcccatccacagaagcagccgggctgcggagcatcagtccattactcag<br>cggaccccatcgcgccctgcaagcctccaacgagacacagccatccggtgcagagcagtccggctagtcccgagagccggggcgtgaccagacagcgcgctcca<br>gtaccgcctcctgcctcaacctgccccaaggtgcctccaggtcccatgatgatccccgactacctgctaacccctgtctacttaag<br>gggctggcacccagacacacagaagccttccaggcctgcagacgccgccagacttgcacgccacagcctgctaaccctgtcttactattag<br>gcctgcacctcagtcggctccccaggaccctgaagcctcaataacccagctccagcctgctcagcgccgcatgcgcaa<br>gtaccccaccagcagccccaagagccccaacgaccctgccccagctggtgccagagtcctgcccgccgctgatgcgccgctctcccCGA<br>GCGACAACCTGGTGAGAcacatccgcatccacacaggccagaagccctcccagtgccgatctgcatgAGAaacttc<br>agcCGAGAGGATAACTTGCACACTcacatccgcaccacaaccggcgaaaagccctgccctgccgaccgacatctgtgga<br>agaaagtgtcCCGAGCATGTGATATATGTGGGAGAAAGTTCTCCCATCAGGGAATCTGACTG<br>GCCATTCGCATGCATGTGATATATGTGGAGAAAGTTGTCCGACACATCCGGACACACCGGGAGAGAA<br>AGcacatcccgatccacacaggccagaagccctccagtgccgcatctgcatgAGAaacttcagcACAAGTGGACATC<br>TGGTACGCcacatccgcaccacaggccgaaaagccttgcctgcgacatttgtgaagaaagttgccCAGAATAG<br>TACCCTGACCGAAcatccagatccacctgccgaaaaagccttgcctgcgacatttgtgaagaaagttgccCAGAATAG<br>ccatcccgtgccaccctctctcctaccgctgcccggttactctattcatccccggccaccacctcata<br>ccatcccgtgccaccctctctctcccgcctcagttcagacagctcagcgctcccttgtcgcacgtggctccctcccgtcggtggca<br>ccagtacctcctgttcccctgcttccccgcgccgagtcagcagcaatttgcttaaACTAGTAAGCTTGGGTGCATCCCTG<br>TGACCCCCTCCCAGTGCTCCTCCTGCCCTTGGCCACCTCCAGTGCCCACCA<br>GCCCTTGCCTCTAATAAAATTAAGTTGCATCATTTTGCTCTGACTAGTGCTCTTCTATA<br>ATATTATGGGCCTGAGGGGGTGTTATTGGAACCAAGCTGGAGTGCAGTGGCACATGGAAGACAA<br>CCTGTAGGCCTGCGGGGGTCTATTGGAACCAAGCTGGAGTGCAGTGGCACAATC<br>TTGGCTCACTGCAATTCCCGCCTTCCGGGTTCAAGCTGCGATTCTCCTGCCTCAGCCTCC<br>CGAGTTGTTGGGATTCCAGGCATGCATGACGATGACCAGGCTCAGCTTAGCTCAGCTAATTTTGTTTTTG |

TABLE 16-continued

Nucleic acid sequences of exemplary eTFs disclosed herein that can upregulate SCN1A expression

| eTF Protein SEQ ID NO: | Nucleic Acid SEQ ID NO: | Nucleic Acid Sequence |
|---|---|---|
| | | GTAGAGACGGGGTTTCACCATATTGGCCAGGCTGCTTCCAACTCCTAATCTCAGG TGATCTACCCACCTTGGCCTCCCAAATTGCTGGGATTACAGGCGTGAACCACTGCT CCCTTCCCTGTCCTT |
| | SEQ ID NO: 442 | ATGGCCCCAAAGAAGAAGCGGAAGGTCGGTATCCACGGAGTCCCAGCAGCCCTCG AACCAGGTGAAAAACCTTACAAATGTCCTGAATGTGGGAAATCATTCAGTCGCAG CGACAACCTGGTGAGACATCAACGCCACCATAGGAGAGAAAACCTTATAAATGT CCAGAATGTGGAAAGTCCTTCTCACGAGAGGATAACTTGCACACTCATCAACGAA CACATACTGTGAAAAACCATACAAGTGTCCGAATGTGGTAAAAGTTTTAGCCG GAGCGATGAACTTGTCCGACACCAACGAACCCATACAGGCGAGAAGCCTTACAAA TGTCCGAGTGTGCAAGAGCTTCTCACAATCAGGGAATCTGACTGAGCATCAAC GAACTCATACCGGGGAAAAAACCTTACAAGTGTCCAGAGTGTGGGAAGAGCTTTTC CACAAGTGGACATCTGGTACGCCACCAGGACACATACAGGGAGGAAGCCCTAC AAATGCCCCGAATGCGGTAAAAGTTTCTCAGAATAGTACCCTGACCGAACACC AGCGAACACACACTGGGAAAAAAACGAGTAAAAGGCCGGCGCCACGAAAAAAGG CCGGCCAGGCAAAAAGAAAAAGGGGATCCTACCCCATACAGGACGTACCAGATTACGC TCTCGAGGAGGGCCAGCCGTTCCGACGGGCTGACGCCATTGGACCATTTTGATCTGG ATATGCTGGAAGTGACGCCCTCGATGATTTTGACCTTGACATGCTTGGTTCGGAT GCCCTTGATGACTTTGACCTTCGGACATGCTGCCCCCTTGATGATTTCGA CCTGACATGTCTGATTAACTCTAGAAGTTCCGGATCTCCGAAAAGAAACGCAAA GTTGGTAGCCAGTACCTGCCCGACACCTACCGGACGACCTCAGTTCGACGAGATCTG GAAGCGGACCTACGAGACATTCAAGAGACATCATGAAGAAGTCCCCCCTTCAGCGG CCCACCGACCCTAGAACCTGCCCCCGAACCTGCCCGTGCCCAGAGATCCAGC GCCAGCGTGCCAAAACCTGCCCCCTACCCTTCACCAGCAGCCTGAGCAC CATCAACTACGACGAGTTCCTACATGGTGTTCCCAGCGGCCAGATCTCTCAGG CCTCTGCTCTTGGCTCCAGCCCTCCTCCAGTGCTCCAGGCTCCTGCTCCTGCAC CAGTCCAGCCATGGTTCCAGGCTTCTGGCTTCAGGCACCAGCACCCGTGCCTGTGCTG GCTCCTGGACCTCCACCAGGCTGTGCTCCACGAGCTGGCTACACAGGCCGG CGAGGGCACACTGTCTGAAGCTCTGCTGCAGCTGCCAGTTCGACGACGAGGATCTG GGAGCCCTGCTGGGAAACAGCACCGATCCTGCCGTGTTCACCGACCTGGCCAGCG TGGACAACAGCGAGTTCCAGCAGTCTGATGGAATACCCCAGGCATCACCCGGCTGTGACA CACCAGCGAGCCCATGCTGATGAATACCCCAGGCCATCACCCGGCTCTGTGACA GGCGCTCAGAGGCCTCCTGATCAGCTCCTCTGCCCCTCTGGGAGCACCAGGCCTGCC TAATGGACTGCTGTCTGGGCAGGAGGACTTCAGCTCTATCGCCGATATGAGGATTTCT GACCTTGCTGGGCTCTGCAGCCGCGGGGATTCCAGGAAGGGATGTTTTTG CCGAGCCTTGAGGGCCGAGCTCCGCTATTAGTAGACTGTGTTTGAGGGCCGAGGTGT GCCAGCCAAAACGAATCCGGCCATTTCATCCTCCAGGAAGTCATGGGCCAACCG CCCATCTCCCGCCAGCCTGCACCAACACCAGCCGGTCCAGTACATGAGCCAGTCG GGTCACTGACCCCGGCACCAGTCCCTGCCCAGGTGGATGCCGCCCAGCTGTCA CCCGAGGCCAGTCACCTGTTGAGGATCCCGATGAAGAAGGAACGAGCCAGCTGTCA AAGCCCTTGGGAGATGCCTTTCCCATGAATCCCGCATACTGTATTCCAAGGGGCCATGAAGGCTGCAAT CTGTGGCCAAATGAACCCTTTCCCATCCGCCCATCACCAACACCGGTCAGTACATGAGCCAGTCG CAACCACATTGAGTCATGACCAGGATTCGATGACCTGAACCCGGACTCCAGGCTGACCCCG GAATTGAACGAGATTCGGATACCTTCCTGAACGACGAGTGCCTCTTGCATGCCAT GCATATCAGCACAGGACTGTCCATCTTCGACACATCTCTTT |

TABLE 16-continued

Nucleic acid sequences of exemplary eTFs disclosed herein that can upregulate SCN1A expression

| eTF Protein SEQ ID NO: | Nucleic Acid SEQ ID NO: | Nucleic Acid Sequence |
|---|---|---|
| | SEQ ID NO: 443 | ATGGCCCCAAAGAAGAAGAAGCGGAAGGTCGGTATCCACGGAGTCCCAGCAGCCCTCG<br>AACCAGGTGAAAAACCTTACAAATGTCCTGAATGTGGAAATCATTCAGTCGCAG<br>CGACAACCTGGTGAGACATTCAACGCACCCATAACAGGAGAGAAAAACCTTATAAATGT<br>CCAGAATGTGGAAAGTCCTTCTCACGAGAGGATAACTTGCACACTCATCAACGAA<br>CACATACTGTGAAAAACCATACAAGTGTCCCGAATGTGGTAAAAGTTTTAGCCG<br>GAGCGATGAACTTGTCCGACACCAATACAGGCGAGAAGCCTTACAAA<br>TGTCCCGAGTGTGGCAAGAGCTTCTCACAATCAGGGAATCTGACTGAGCATCAAC<br>GAACTCATACCGGGGAAAAACCTTACAAGTGTCCAGAGTGTGGGAAGAGCTTTTC<br>CACAAGTGGACATTGGTACGCCACCAGGAGCACATACAGGGGAGAAGCCTAC<br>AAATGCCCCGAATGCGGTAAAAGTTTCTCCAGAATAGTACCCTGACCGAACACC<br>AGCGAACACACACTGGGAAAAAAAGAGTAAAAGGCCGGCGGCCACGAAAAAGG<br>CCGGCCAGGCAAAAAAGAAAAAGGGATCCTACCCATACGACGTACCAGATTACGC<br>TCTCGAGGACGCGCTGGACGATTTCGATCTCGAACATGCTGGGTTCTGATGCCCTCG<br>ATGACTTTGACCTTGATATGTTGGGAAGCGACGCATTGGATGACTTTGATCTGGAC<br>ATGCTCGGCTCCGATGCTCTGGACGATTTCGATCTCGATATGTTA |
| | SEQ ID NO: 444 | ATGGCCCCAAAGAAGAAGAAGCGGAAGGTCGGTATCCACGGAGTCCCAGCAGCCCTCG<br>AACCAGGTGAAAAACCTTACAAATGTCCTGAATGTGGAAATCATTCAGTCGCAG<br>CGACAACCTGGTGAGACATTCAACGCACCCATAACAGGAGAGAAAAACCTTATAAATGT<br>CCAGAATGTGGAAAGTCCTTCTCACGAGAGGATAACTTGCACACTCATCAACGAA<br>CACATACTGTGAAAAACCATACAAGTGTCCCGAATGTGGTAAAAGTTTTAGCCG<br>GAGCGATGAACTTGTCCGACACCAATACAGGCGAGAAGCCTTACAAA<br>TGTCCCGAGTGTGGCAAGAGCTTCTCACAATCAGGGAATCTGACTGAGCATCAAC<br>GAACTCATACCGGGGAAAAACCTTACAAGTGTCCAGAGTGTGGGAAGAGCTTTTC<br>CACAAGTGGACATTGGTACGCCACCAGGAGCACATACAGGGGAGAAGCCTAC<br>AAATGCCCCGAATGCGGTAAAAGTTTCTCCAGAATAGTACCCTGACCGAACACC<br>AGCGAACACACACTGGGAAAAAAACGAGTAAAAGGCCGGCGGCCACGAAAAAGG<br>CCGGCCAGGCAAAAAAGAAAAAGGGATCCTACCCATACGACGTACCAGATTACGC<br>TCTCGAGGACGCGCTGGACGATTTCGATCTCGAACATGCTGGGTTCTGATGCCCTCG<br>ATGACTTTGACCTTGATATGTTGGGAAGCGACGCATTGGATGACTTTGATCTGGAC<br>ATGCTCGGCTCCGATGCTCTGGACGATTTCGATCTCGATATGTTA |
| | SEQ ID NO: 445 | ATGgccgcggccaaggccagtcagtcagtgatgtccccgctgcagtcgtgatgtgtccccctgaccgtcgagatctctgaccgtcgagatcctgaccgtcggatcattcctcactgcgccaccatg<br>gacaactacccctaagctgaggagatgatgctgctgagcaacgggctccccagtctctgagcacagggtcccgggccgcaggtccccagtccccagtcctcggcgcgccggcagcagcgcaggggcag<br>cggcagcacagcagcagcgggcagcgcgcccccgcgcgggagcgggcggcaggaccagcacccagcacaccagcgggcggcagcagcagcacc<br>ttcaaccctcaggcggcgacagggcagcagccgcaaaccactcagcttcagcttgcagcgagagttattctcgacatctctccctgagcctgaacaacgagaagt<br>gctggtggaagaccagttacccgccgagcccctcttcagcttgcagcttggtcagtggcgcatgagcagcagcgtgtcctcagcagtccagcagcagtccccagtccccatttactca<br>cattccagcggcctccccagcgccgtcttcccagaccaagcttcctgagcaacaagacaggccttcccggctcggcggcagcgctccagggacagtcc<br>gggcacccaccttccccacgccgctacctctcgccaaggtggcttcaaggttccatgatgatcccgactcagcccccgactacccctcgctaccccctcgtctactattaag<br>tgggctgggcaactcagtcgggcctccaaggacctcgaaggcctcaataccagtccgacaccagcgcaggccttacccccgaggctcagcagagccctcaataccagtccgcacccggcttatccctccaaagccgcatcgcgaca<br>gcctcgcactcagtcgggctcccagcagcccccgacccaaccccaccagccctacgcttgccccaccgcaagccggaggtcctgtgatcgcacccgagtccttccccGCA |

TABLE 16-continued

Nucleic acid sequences of exemplary eTFs disclosed herein that can upregulate SCN1A expression

| eTF Protein SEQ ID NO: | Nucleic Acid SEQ ID NO: | Nucleic Acid Sequence |
|---|---|---|
| | SEQ ID NO: 446 | GCGACAACCTGGTGAGAcacatccgcatccacacaggccagaagccttccagtgccgcatccgcatgAGAaacttc agcCGAGAGATAACTTGCACACTcaacatccgcaccacacaggcgcaccaaaagcccttcgcctgcgacatctgtga agaaagtttgccCGAGCGATGAACTTGTCCGAcatacccaagatccaactgcgcagaaggacgccgcttacgcttg cccagtggagtcctgatcgccgcttcccAATCAGGGAATCTGACTGAGCacatccgcatccacacaggccag aagccttccagtgccgcatctgcatgAGAaacttcagcACAAGTGGACATCTGTACGCcaatccgacaatccac acaggcgaaaagccttcgctgcgacatctgtggaagaaagtttgcCAGAATAGTACCCTGACCGAAcatacca agatccactgcctcttaccccgtcggcagaaagtgagcGCTAGCtcggcaccctctctcctcctgccaccccctgcttcc cggttgctacctcttacccgtccccatcccctgcgcagtggcttccctcccgcggtggccaacgactccttgacccctgttcc tccgggtctctcgacctaccatcccctgtgcagtggcttccctcccgtcggtggccaacgactccttgaccccctgttcc cggccaggtcagcagtctccttcctcctcagctgtcaccaactccttcagcgcctccacaggggcctcgccacattctcc caggacaattgaaattgc |
| | SEQ ID NO: 447 | ATGGCcggccgcaaggccgagatcgatgtccccctgcagatctctgaccgttcggatcctttcctcactgccaccatg gacaactacctaagctggaggagtatgtctgctgagcaacggggctcccagttcctcggcgcgccgggcccagagggcag cggcagcaacagcagcagcagcagggggcggtgagggcggcagcaacagcagcagcagcagcacc gctgtggaccagttacccacgcgcagcagcgaccgcacctgaccgcagagtcttactggcccgctttccctgagcgtcaccaaca gtggcaacacttggccgcccgagccccctccgctcagttggcagtgaccggcccaccgccagcagcagcagttcagcagcac catctccagcggccctccccccgcgcgaaccacgtccccagaagcccgcacgacacaggcgccagtgcgcagcagttcacttca gggcacccacctccgcctccgcgcaactgacctttcctcgagcacaagcccatgacccgccatgatcccgacctacctgatccaccgcgtcc agtaccgcgctcctgcgcgcccaggcccggccaggaagccctcctacccctgcctcctgcctgagctggaggagcggaggctgc |

TABLE 16-continued

Nucleic acid sequences of exemplary eTFs disclosed herein that can upregulate SCN1A expression

| eTF Protein SEQ ID NO: | Nucleic Acid SEQ ID NO: | Nucleic Acid Sequence |
|---|---|---|
| | | gccttgcactcagtcgggctcgggactcccaggacctgaaggcctccaataccagtccagctacccagtcccagctcatcaaaccagccgcatgcgcaa<br>gtacccaaccggccaagacgcccccacacgacgaacgcctacgctgccgatcctgccagtgagtcctgatgcgcttctccCGCT<br>CAGACAACCTCGTTCGAcacatccgcaagccccttccagtgccgcatccgatgAGAaactc<br>agcCACCGGACTACACTCCACGAACacatccgcacccacaggcgaaaagccctcgcctgcgacatctgtgga<br>agaagttgccAGAGAAGACAATCTCCATACTCACATCCGGACACACACGGAGAGAA<br>GCCATTCGCATGtGATATATGTGGGAGAAAGTTCTCCACCAGCCATTCTCTCACTGA<br>AcacatccgcatccacacaggccagaagcctcagcctgAGAaacttcagcCAGTCTAGCTCACT<br>GGTGAGGcacatccgcaccacacaggcgaaaagccctcgcctgcgacatctgtggaagaaaagttgccAGGGAGGA<br>TAACCTGCATACGcataccaagatccacttgcggcagaagcagacaaagaagtgagtgGCTAGCtcgg<br>cccatcctcctctcctcctaccgtcccgtgctactctcttaccgtccccggtgctactctcatccccggcaccacacctccata<br>ccatcccctgtgccactcctccttctctccgcagccctaccatcccctgcgcagtggcttccccctccccgtcggtggcca<br>ccacgtactccttctgacccctgcttccggccaggtcagcagctccttcctccagtcgtcaccaactccttcagcgtctgaaattgc<br>ctttcggacatgacgcagcaaccttttctcccaggacaattgaaatttgc |
| | SEQ ID NO: 448 | ATGGCCgccgccaccactgctgctcgccgagggctaccgctgtgcagaggcgccgtccgcgccgctccatggcctca<br>tgcgctccgactctcgcgccgtacgggcccctggacacatgggcctgaggcgcggggcgctgagcggcccgccgccg<br>ccccgcaaccgggcccctgagctgacgccccggccgcctgcggcacgccgcctcagtcccggagcccccccgggc<br>ccgagccgccaagcgccagctggagctggggcgcacccggcgacgcctgagctgcacgcccagagcggagtcgactgc<br>gcgcgacgtcgctggagctgagctcccgccgcccgggtccgtgagctgctggtgtctggtcagtcccagctcctgtgatcgc<br>ttctcggacttgggctccgcaagtacccccagcaagacgaacgcctcacacaggccagaaagccctccagtgccgcatct<br>cgcttctccCGACGACCAACCTGTGAGacgagcCGAGAGGATAACTTGCACACTCacatccgcacacaggcgaaaagcccttcgc<br>gcatgAGAaacttcagcCGAGAGGATAACTTGCCGAGcCGATGAACTTGTCCGAcataccaagatccacttcggcagaag<br>ctgacatctgtgaagaaagttgcCCagtggagtcctgatgccgatctgatgccgcttctcCAATAGGGAATCTGACTGAGcacatccg<br>gaccgccttacgctgccagaagccctcagtgccgactctgcagtgAGAaacttcagcACAAGTGGACATCTGGTACG<br>catccacacaggccagaagccttcagtgccgactctgcgacatctgtggaagaaagttgccCAGATAGTACCCTG<br>ACCGAAcatacccaagatccacttcgggcagaaggcaag |
| | SEQ ID NO: 449 | ATGGCCgccgccaccactgctgctcgccgagggctaccgctgtgcagaggcgccgtccgcgccgctccatggcctca<br>tgcgctccgactctcgcgccgtacgggccctggacacatgggcctgaggcgcggggcgctgagcggcccgccgccg<br>ccccgcaaccgggcccctgagctgacgccccggccgcctgcggcacgccgcctcagtcccggagcccccccgggc<br>ccgagccgccaagcgccagctggagctggggcgcacccggcgacgcctgagctgcacgcccagagcggagtcgactgc<br>gcgtcgacgtcgctggagctgagctcccgccgcccgggtcgtgagctgctggttcgttgcccagtgcccagtcctgtgatcgc<br>ttctcggacttgggctccgcaagtaccccagcaaccggccaccggcccacatccgcacatccgcacacaggccagtgccgcatcctg<br>catgAGAaacttcagcCGCTCAGACACTACCACCGGAcCATGACACAGCCACACCCGAAcaccaggcgaaaagccctcgcct<br>gcgacatctgtggaagaaagttgcCAGAGAAGACAATACTCatacccaagatccacttcggcagaagga<br>cggccccttacgcttgccagtgagtcctgtatcgccgctcgatgccgcatctgcatgAGAaacttcagcCAGTCTAGCTCACTGGTGAGGca<br>caacaggccagaagccctccagtgccgaaaagccctcgcctgcgacatctgtggaagaaagttgcCAGGGAGGATAACCTGCA<br>TACGCataccaagatccacttcggcagaaggaccaagCTGAgatcgcggaaggaccacactgctgccgaggcgtacccggcctg |

TABLE 16-continued

Nucleic acid sequences of exemplary eTFs disclosed herein that can upregulate SCN1A expression

| eTF Protein SEQ ID NO: | Nucleic Acid SEQ ID NO: | Nucleic Acid Sequence |
|---|---|---|
| | SEQ ID NO: 450 | gtgcagaggccgcgtccgccgccgccatggccgcctcatgcgctccggacttgcgcgccgtctgcgggccgggcctgacgcgggcccgggcctggacag tgggtgaggccgcggggctccgctggggcctcgcgccgcgcccaaccggggcctggcgcccgacctgtggcgacgccgggcccggttcgggcgcc gtcctcctttccagcctacccgggccctacgggcctccgcgcgccgcgcatccgccgcctggcgaccctgtggcgactgtaccccggccgc gcggccgccgccccaacgtccggaggcccccaagcgccggggccagcgcagccccccgggctgggacgcccgcagcccgcgccgcgca cgcctggccgggcatgacgacgcgaactcatcgacgaggagcgctgacgtcgtcgagctggtccgccgcgcctgggtgaccgtgcgc gagtgcccgagctgacctggcccagacgagtctgactgatctggacttggggtcctgcgcgcgcccatggccctca<br><br>ATGGCCgccgaccacctgatgtctcgcgaaggctaccgctggtcagagcgccgtccgcgccatggccctca tgcctccgactctgcccgctcaccgggccccggggcctggacagtggccgggctgagcgccgggggctcgtgggcccgcgccg cccgccaaccccggggccctggccggtgtgcgacccgtccgcccccgccgcccacgcccggcaccgcaggagcaggagccgg gcgatggccgacctgcagcctgtgtgcgacccgtaccccgggccgccgacccgggccccgggcctgggcacgccgaactcatccgacgaggag gcgtgactgcgtggagctgagtccgggcccagcccctgggccgggctcggggggctgcaccgggcggctgcgccgagctgactgggcgcagatcgactgc ttccggaacttgggcctgccgggccccgggcccagcccctggaggggcggggctcgtgtggttctctgtcgtcgcggccgggccatgcagctcatcaaaccc agccgccatggccaagtacccccaagcggcccaagcgggccccaacggcagcccccatcgcggcccgcgcgcggggccagcccctactgcgtccagcccctactgcgctgatcgc cgcttctcCGCTCAGACAACCTCGTTCGAcacatccgcatccacacaggccaccacaggcgaaagcccttcgcct catgAGAaacttcagcCACCGGACTACACTCCATACTcataccaagatccaacttgcgcagaagga gcgacatctgtggaagaaagtttgcCAGAGAAGACAATTCCATACTcataccaagatccaacttgcgcagaagga ccgcccttacgcttgccccagtgccgtgagtccgtcgtgatcgccgatctcatgAGAaacatcagcCAGTCTAGTCACTGGTGAGGca cacaaggccagaagcccttccagtgccgtacgctcgccatccagcCATCCTCACTGAACacatccgcatc catccgcacccacaagcgaaaagcccttcgcctgcgactgccagccttgcgcatctgtggaagaaagtttgcCAGGAGAGATAACCTGCA TACGcataccaagatccaacttgggcagaaggacaag |
| | SEQ ID NO: 451 | ATGGCcgcggccgcaagcgcagatgcagccgatgtgtctccgctgagatctcgaccgttcggatctcttttcctcactgccactgccccatg gacaactaccctaagctgaggagagtgatgtctgctgagcaacgggtccagcggtcctcctggcgcgccgcgcggcccaaggggcag cggcagcaacagcagcagcagcggggctgagcagcccctacgacgccagagtttcaagttttccctctcgacatcctctgaacaacgagaaggt ttcaaccctcaggcggcgacaggcgagcagcccttacgacgcaccggacagagtcttaactgacatcctctgaacaacgagaaggt gctgtgagaacacttgtggcccgagcctcttcagttgcagtgccctcagccgttcagtgacatctctggagcgcctgcacccaaca gtgcaacacttgtggcccgagcctcttcagttgcagtgccctcagtgacgatgacactgtgccaccggctcctctgtcctcagcac catttccagcgctccttccccacggcaacactgacattttcctgagccacaaagcagctggacaaacggccatcgatccaagcagcaggggatc agtaccggcctctgctaccctgcccaggaccaggagcagcaggagccgacccagaccagcttcgctaacccctgtctactattaag tgggctggcactcgtggggctcccagaccaagaagcccttccaggcctgaagccctcaataccagccttgccagtccctgtctaccctctgtctactattaag gcaccaacaccggccagaagacgcaccccgaagccctcaatccacgtgactgcCTCATCTCAcaactcacgtcgcactactattaag GCGACAACCTGGTGAGAcAcaactgcagcCGATGAACTTGTCCGAcataccaagatccacaccaccaccagccgaatgcgcaa agcCGAGAGATAACTTGCACACTcatactcgatccgcctcttccCAATCAGGGAATCTGACTGActCacactcggcttg agaagttgccCGGAGACCGATGAACTTGTCCGAcacacatcccgccattgACATCAGGGAATCTGACTGActCacactcggcttg cccagtgagtcctgtctgactgccgcatctgcatgAGAaaacttcagcACAAGTGGACATCTGGTACGccatccgcacccaccggcag aagccctttcagtgccgaactcgcatctgcatgAGAaaacttcagcACAAGTGGACATCTGGTACGccatccgcacccaccggcag acaggcgaaaagcccttcgcctgcgactgtgtgaaggcgaaaagtttgccCAGAATAGTACCCTGACCGAAcatacca |

TABLE 16-continued

Nucleic acid sequences of exemplary eTFs disclosed herein that can upregulate SCN1A expression

| eTF Protein SEQ ID NO: | Nucleic Acid SEQ ID NO: | Nucleic Acid Sequence |
|---|---|---|
| | | agatccacttgcggcagaagcagaagaagcagacaaaagtgagtgGCTAGCtcggccaactcctctctctctcctaccgtccc<br>cggttgctacctcttaccgtccccggttactacctcttatccatccccggccaccaccatccccctgtgccaccctcctcctc<br>tcccggctcctcgacctccccgctcccggtcccccgtgtgccacagtgactcctgaccctgctttcc<br>cggccagtcagcagctttccttcctcagctgtcaccaactccttcagcgctccacagggcctccacagggcttcgacatgacagcaaccttactcc<br>caggacaattgaaatttgc |
| | SEQ ID NO: 452 | ATGGccggccgccaagccggagatgcagctgatgtccccgctcgagatctctgaccgtcggatctcttcctcactcgccactg<br>gacaactacccctaagctggagagagtgatgtctgctgagcaacggggtcctcggccacagtcctcggcgcgccaagggcag<br>cggcagcaacagcagcagcagcggggcgtgaggcgcggcagcagcgcaacagcagcagcagcagcacc<br>ttcaaccctcaggcggaccagttacccccagccaaccactcgactgccccccatcctcgactgagatcctctggagcgtttccctggagctgcaccaaca<br>gctgtggagacccagttaccccagccaaccactcgactgccccccatcctcgactgagatcctctggagcctgcaccaaca<br>gtggcaaacctgtggccgagccctccttcagcttggtcagtgcctccaggcactgtgactgagtgctcctagttccctcagcac<br>cattccaggcgctcctcccctcgcctcccagagcccaacactgacattttccctgagccacaaagcaggcctccccaggctcggtccattactca<br>gcgcaccacctccccacgccaacactgactttttcctgagccacaaagcaggcttcccgggtcggcaggacagcgctcc<br>agtaccgcctctgcctaccctgccaaggtggcttccaggacccatgatccccgactacctgatccacagcaggggatc<br>tgggctggcaccccagacagagcccttccaggggtcttggtgttcggaggcgcccagcagcctcgtaaccctctgtactattaag<br>gcctttgccactcagtcgggctcccaggacctgaaggccctcaataccagctaccagtcccagctcatcaaaccagccgcatgcgcaa<br>gtacccaaccggccagaagacgccccccaagacgccctttacgcttgccagtggagtcctgtcgccgatcgcgatAGAaacttc<br>GCGACAACCTGGTGAGAcacatcgcACACTcacatcgcacacaacgcaaagaagcccttcgcctgcgacatctgtgga<br>agcCGAGAGATAACTTGCACACTcacatcgcacacaacgcaaagaagcccttcgcctgcgacatctgtgga<br>agaaagttgccCGAGCGATGATATATGTGGAGAAAGTTCTCCCAATCAGGGAATCTGACTG<br>GCCATTCGCATGtGATATATGTGGAGAAAGTTCTCCCAATCAGGGAATCTGACTG<br>AGcacatccgcatccacacaggccagaagccctttcagtgccgatctcgcatgAGAaacttcagcACAAGTGGACATC<br>TGGTACGCcacctaccccacaccaggccagaagccttccagtgccgatctgcgcaAGAaacttcagcACAAGTGGACATC<br>TACCCTGACCGAAcataccaagatccacttgcgcagaagacagaacaaagtgagtgGCTAGCtcgg<br>ccactcctctctcctcgtcccccggttgctactccttatcatcccccggccaccacctcata<br>ccacgtagcctctgttccctccccctcccttcctgcagctagcagctccctggcagttgccgtcaccctcagcgctgcca<br>ccacgtagcctctgttccctccccctccctgcagctagcagctccctggcagttgccgtcaccctcagcgctgcca<br>cttcggacatgacaacctttctcccaggacaattgaaatttgc |
| | SEQ ID NO: 453 | ATGGccggccgccaagccggagatgcagctgatgtccccgctcgagatctctgaccgtcggatctcttcctcactcgccactg<br>gacaactacccctaagctggagagagtgatgtctgctgagcaacggggtcctcggccacagtcctcggcgcgccaagggcag<br>cggcagcaacagcagcagcagcggggcgtgaggcgcggcagcagcgcaacagcagcagcagcagcacc<br>ttcaaccctcaggcggaccagttacccccagccaaccactcgactgccccccatcctcgactgagatcctctggagcctgcaccaaca<br>gctgtggagacccagttaccccagccaaccactcgactgccccccatcctcgactgagatcctctggagcctgcaccaaca<br>gtggcaaacctgtggccgagccctccttcagcttggtcagtgcctccaggcactgtgactgagtgctcctagttccctcagcac<br>cattccaggcgctcctcccctcgcctcccagagcccaacactgacattttccctgagccacaaagcaggcctccccaggctcggtccattactca<br>gcgcaccacctccccacgccaacactgactttttcctgagccacaaagcaggcttcccgggtcggcaggacagcgctcc<br>agtaccgcctctgcctaccctgccaaggtggcttccaggacccatgatccccgactacctgatccacagcaggggatc<br>tgggctggcaccccagacagagcccttccaggggtcttggtgttcggaggcgcccagcagcctcgtaaccctctgtactattaag<br>gcctttgccactcagtcgggctcccaggacctgaaggccctcaataccagctaccagtcccagctcatcaaaccagccgcatgcgcaa<br>gtacccaaccggccagaagacgccccccaagacgccctttacgcttgccagtggagtcctgtcgccgatcgcgatAGAaacttc<br>CAGACAACCTCGTTCGActactCGTTCGAactactCGAACcacatccgcacacaacgcaaagcccttcgcctgcgacatctgtga<br>agcCACCGGACTACACTCACGAACcacatccgcacacaacgcaaagcccttcgcctgcgacatctgtga<br>agaagtttgcCAGAGAAGACAATTCCATCTCCATCCGGACCACACGGAGGAA |

TABLE 16-continued

Nucleic acid sequences of exemplary eTFs disclosed herein that can upregulate SCN1A expression

| eTF Protein SEQ ID NO: | Nucleic Acid SEQ ID NO: | Nucleic Acid Sequence |
|---|---|---|
| | SEQ ID NO: 454 | GCCATTCGATGtGATATATGTGGGAGAAAGTTCTCCACCAGCCATTCTCTCACTGA<br>AcacatccgcatcccacacaggccagaagcccttccagtgccgcatctgcatgAGAaacttcagcCAGTCTAGCTCACT<br>GGTGAGGcacatccgcacccacacaggcgaaaagccctttcgcctgcgactctgtggaagaaaagtttgccAGGGAGGA<br>TAACCTGCATACGcataccaagatccacttgcggcagaagacaagaaagcagacaaaagtgagtgGCTAGCtcgg<br>ccacctcctctcttcctcttcctaccgtccccggtgctacctcttaccgtccccggttactacctcttatccatccccggccaccacctcata<br>ccccatccctctctcctgtgcccaactccttctctctctccgacctacccatccccctgtgcacagtggcttccctccccgtcggtgcca<br>ccacgtactcctctgaccccctgcttccggcccagtctgtccctcctctcagctgtcaccaactcctcagcgcctccacagg<br>ctttcggacatgacagcaaccttttctcccaggacaattgaaatttgc<br><br>ggaggaagccatcaactaactacaatgactgtaagatacaaattgggaatggaatgtaacatatttgaagactgttgacataagaatcatg<br>atattaatgccctatgcctgaaatgaaagggcgatcaacactagtgtttgaaaaggggaaatgtagagcaacagatgttcgtgtgcagtgt<br>gctgtctctagcaatactcagagagagagagaacaatgaaatctgattggcccagtgtgagcccagtgaggttcagctgcaacttt<br>ctcttcaatcttatgaaagtcatttaagcacaacttaacttttattttattttttgagacagagtctgctgagcccagagacagagtgc<br>agtagtgactcaatctcgctcaatgcagcctccactccttctagctccaagcctcctgcatcagctccaccatcaccagtagctggcctca<br>gagtgccccatgcccagctacttagtatttaatagatacaggggtttcaccatatccacccaggctggtctgaactctggcctca<br>agtgatccaactgcctcggcctcccaaagtgctggattataggcgtcagcaactatgccaactccgaccaacctttaaatatt<br>aaaaattgtatttcacatactagtatttcatccacacaaaacggacgggcctccgctgaaccagtgaggcccagacgtgc<br>gcataaataacctgctgtgcaccactgggagaggggaaggacacgtaaatggaggcgagcgcatagcaaaagggacgc<br>ggggtccttactctgccggtgcactggtcacctggtagctgtgcacggtgtgtacttttgatgggccagggtcaaggagcgtc<br>gcagggtcacagatctggggaaccccgggaaccaggcaaaacgccgctcgtctcctacacaatatgggagggaggg<br>ttgagtacgttctgattactcataagacctataatttcctccggcgactagctgcccccgagcaaacgctcgtgattccccgcgatcc<br>ggcggtcaggcacctgcagaggagccccaactgccccgccaccgcggcgctcagccgcgtcagcccgctagcccgatcc<br>gaggaactagcgagaacgaagcaggcgaggtgacccgggcagattacgcgtcaggcctccagggccgaggacgcgtgg<br>gcgctgcagagagcagcgaaagcagggagtgccgctcgtgctcgccagagccgagtgggctatggcttccagc<br>gccaaccgggctttcagccaggtcctctccccgccgaagggtacctcgcgaccatcccagcggggccggggccgaggcagccagccggccagccacctcccgaaat<br>ggtcttcctgcccagacgcgaaggcgctactaggaacggtacctgttaacttaccaggggcgtagccgagtt<br>gctggcgcggccgagcgagggcaagctgcccaagtgcagccctcaggagagaacctaagatatggc<br>ctttacccctctcacctgtctcaccaaagtccctagtccccgacgcgccgagcagtcagctctactaccaggggaattagccagacaacacg<br>ggaaccagacacccgacccagaacgctgccccccgtgccgcctccccgtgcgctgcttcctccctcttgtcctccagccggatctt<br>caagggagcctccgtgcccgctgcgtcagtcctccgtgcgagcgagccccggagtcctccccgaagtcctgcttctctttg<br>cagcctgttctgcccgaccgactcgaggactctgagactgtgcaagtgcaagctaaagatggc<br>TGGcgcggccaagccgaatgcgagctgcagtcgctgcgtgctcctccccgctgattcgcggatcctttctcactcgccaccatgga |

TABLE 16-continued

Nucleic acid sequences of exemplary eTFs disclosed herein that can upregulate SCN1A expression

| eTF Protein SEQ ID NO: | Nucleic Acid SEQ ID NO: | Nucleic Acid Sequence |
|---|---|---|
| | | caactaccctaagctggaggagatgatgctgctgagcaacgggctcccagttcctcggcgcgcggggcccagagggcagcg gcagcaacagcagcagcagcagcggcagcagcggggcgcggcgggtggagcggcggcagcaacagcagcagcagcagcctt caacctcaggcggcacgggcgagcagccctgaccggcaccctgaccagagtcttacctgacatctctgaacaacgagaagtg ctggtggagaccagttacccccagcagcccctcttcagttggtcagtggcctagtgagctgagcatgaccaaccaccggctta cctgacccaacagt ggcaacacctgtgccccgagccccctcttcagctggtcagtggctgcagtgcagtccatttactcag cggcaccccttcccacgccgacattacccctgagccacaaagccaggcctccccggcgctgcgcaggagacaggctcca gtacccgcctctgctacccctgcgccaggatggcttccaagggtggctttccaggagacccatgatccccagacccctgctaaccccctgtctactattaag gcccttgccactcagtcgggctccccaggacctgaaggcctcaataccagtccccagtcatcaaaccagccgcatgcgcaa gtacccaaccgcccagcagacgcccccaccacaggccccacgaagcttacgcttgccagtggtctgtgatcgccgtctccccCGCA GCGACAACCTGGTGAGAcacatccgcatccacacaggccagaagccctccagtccgcatctgcatgAGAaacttc agcCGAGAGATAACTTGCACACTcactaccgaccccacaaggccgaaaagccctcgcgacatctgtgga agaaagttgccCGGAGCGATGAACTTGTCCGACACATCCGGACACACACGGGAGAGAGAA GCCATTCGCATGTGATATATGTGGGAGAAAGTTCTCCCAATCAGGGAAATCTGACTG AGcacatccgcatccacacacggccagaagccctccagtgccgcatctgcatgAGAaacttcagcACAAGTGGACATC TGGTACGCcacatccgcacccacaagatccaccttgcctgcgcatcgcctctgtgagaaagttgccCAGAATAG TACCCTGACCGAACatacccagatccacttgcgcagaaggcagcagcagcagacaaaagtgagtgGCTAGCtcgg ccactcctctctcttcctacccgtcccggttgctactcttatccatcccggcaccacctcata cccatccccgtgccaccctccctgcccgatctctcgacctctaccctgtgcacagtggcttccctcccgtcggtgcca ccagtactcctctgaccccctgcttcccggccccagtcagcagcttcccttcctcagctgtccaactccttcagcgcctcaacaggg ctttcggacctgacgacgcaacctttctccaggacaatgaaattgctaaACTAGTAAGCTTGGGTGCATCCCTG TGACCCCTCCCAGTGCCTCCTGGCCCTGGAGTTGCATCATTTTGTCTGACTAGTGTCTTCTATA GCCTTGTCCTAATAAAATTAAGTTGCATCATTTTGTCTGACTAGTGTCTTCTATA ATATTATGGGCTGCGGGGGGTGTATTGGAGCGAAGGGCAAGTTGGGAAGACAA CCTGTAGGGCCTGCGGGTCTATTGGAACCAAGCTGGAGTGCAGTGGCACAATC TTGGCTCACTGCAATCTCCGCCTCCTGGGTTCAAGCGATTCTCCTGCCTCAGCCTCC CGAGTTGTTGGGATTCCAGGCATGCATGACCAGCTAATTTTTGTTTTTTG GTAGAGACGGGGTTTCACCATATTGGCCAGGCTGGTCTCCAACTCCTAATCCTCAGG TGATCTACCCACCTTGGCCTCCCAAATTGCTGGGATTACAGGCGTGAACCACTGCT CCCTTCCCTGTCCTT |

TABLE 17

Examples of eTFs that upregulate expression of SCN1A

| Expression Cassette | Target Site SEQ ID NO: | DBD SEQ ID NO: | TAD SEQ ID NO: |
|---|---|---|---|
| Control | N/A | None | None |
| A | SEQ ID NO: 35 | SEQ ID NO: 131 | SEQ ID NO: 95 |
| B | SEQ ID NO: 35 | SEQ ID NO: 131 | SEQ ID NO: 114 |
| C | SEQ ID NO: 36 | SEQ ID NO: 132 | SEQ ID NO: 95 |
| D | SEQ ID NO: 36 | SEQ ID NO: 132 | SEQ ID NO: 114 |
| E | SEQ ID NO: 37 | SEQ ID NO: 133 | SEQ ID NO: 95 |
| F | SEQ ID NO: 136 | SEQ ID NO: 134 | SEQ ID NO: 114 |
| G | SEQ ID NO: 107 | SEQ ID NO: 103 | SEQ ID NO: 95 |
| H | SEQ ID NO: 108 | SEQ ID NO: 103 | SEQ ID NO: 114 |

TABLE 18

Sequences of eTFs that upregulate expression of SCN1A

| eTF SEQ ID NO: | eTF protein sequences |
|---|---|
| SEQ ID NO: 305 | MAPKKKRKVGIHGVPAALEPGEKPYKCPECGKSFSRSDNLVRHQRTHTGEKPYKCPECGK SFSREDNLHTHQRTHTGEKPYKCPECGKSFSRSDELVRHQRTHTGEKPYKCPECGKSFSQS GNLTEHQRTHTGEKPYKCPECGKSFSTSGHLVRHQRTHTGEKPYKCPECGKSFSQNSTLTE HQRTHTGKKTSKRPAATKKAGQAKKKKGSYPYDVPDYALEEASGSGRADALDDFDLDML GSDALDDFDLDMLGSDALDDFDLDMLINSRSSGSPKKKRKVGSQYLP DTDDRHRIEEKRKRTYETFKSIMKKSPFSGPTDPRPPPRRIAVPSRSSASVPKPAPQPYPFTSS LSTINYDEFPTMVFPSGQISQASALAPAPPQVLPQAPAPAPAPAMVSALAQAPAPVPVLAPG PPQAVAPPPAPKPTQAGEGTLSEALLQLQFDDEDLGALLGNSTDPAVFTDLASVDNSEFQQL LNQGIPVAPHTTEPMLMEYPEAITRLVTGAQRPPDPAPAPLGAPGLPNGLLSGDEDFSSIAD MDFSALLGSGSGSRDSREGMFLPKPEAGSAISDVFEGREVCQPKRIRPFHPPGSPWANRPLP ASLAPTPTGPVHEPVGSLTPAPVPQPLDPAPAVTPEASHLLEDPDEETSQAVKALREMADTV IPQKEEAAICGQMDLSHPPPRGHLDELTTTLESMTEDLNLDSPLTPELNEILDTFLNDECLLH AMHISTGLSIFDTSLF |
| SEQ ID NO: 306 | MAPKKKRKVGIHGVPAALEPGEKPYKCPECGKSFSRSDNLVRHQRTHTGEKPYKCPECGK SFSREDNLHTHQRTHTGEKPYKCPECGKSFSRSDELVRHQRTHTGEKPYKCPECGKSFSQS GNLTEHQRTHTGEKPYKCPECGKSFSTSGHLVRHQRTHTGEKPYKCPECGKSFSQNSTLTE HQRTHTGKKTSKRPAATKKAGQAKKKKGSYPYDVPDYALEDALDDFDLDMLGSDALDDF DLDMLGSDALDDFDLDMLGSDALDDFDLDML |
| SEQ ID NO: 307 | MAPKKKRKVGIHGVPAALEPGEKPYKCPECGKSFSRSDNLVRHQRTHTGEKPYKCPECGK SFSREDNLHTHQRTHTGEKPYKCPECGKSFSRSDELVRHQRTHTGEKPYKCPECGKSFSQS GNLTEHQRTHTGEKPYKCPECGKSFSTSGHLVRHQRTHTGEKPYKCPECGKSFSQNSTLTE HQRTHTGKKTSKRPAATKKAGQAKKKKGSYPYDVPDYALEDALDDFDLDMLGSDALDDF DLDMLGSDALDDFDLDMLGSDALDDFDLDML |
| SEQ ID NO: 308 | MAPKKKRKVGIHGVPAALEPGEKPYKCPECGKSFSRSDNLVRHQRTHTGEKPYKCPECGK SFSREDNLHTHQRTHTGEKPYKCPECGKSFSRSDELVRHQRTHTGEKPYKCPECGKSFSQS GNLTEHQRTHTGEKPYKCPECGKSFSTSGHLVRHQRTHTGEKPYKCPECGKSFSQNSTLTE HQRTHTGKKTSKRPAATKKAGQAKKKKGSYPYDVPDYALEDALDDFDLDMLGSDALDDF DLDMLGSDALDDFDLDMLGSDALDDFDLDML |
| SEQ ID NO: 309 | MAPKKKRKVGIHGVPAALEPGEKPYKCPECGKSFSRSDNLVRHQRTHTGEKPYKCPECGK SFSHRTTLTNHQRTHTGEKPYKCPECGKSFSREDNLHTHQRTHTGEKPYKCPECGKSFSTSH SLTEHQRTHTGEKPYKCPECGKSFSQSSSLVRHQRTHTGEKPYKCPECGKSFSREDNLHTH QRTHTGKKTSKRPAATKKAGQAKKKKGSYPYDVPDYALEEASGSGRADALDDFDLDMLG SDALDDFDLDMLGSDALDDFDLDMLINSRSSGSPKKKRKVGSQYLPD TDDRHRIEEKRKRTYETFKSIMKKSPFSGPTDPRPPPRRIAVPSRSSASVPKPAPQPYPFTSSL STINYDEFPTMVFPSGQISQASALAPAPPQVLPQAPAPAPAPAMVSALAQAPAPVPVLAPGP PQAVAPPPAPKPTQAGEGTLSEALLQLQFDDEDLGALLGNSTDPAVFTDLASVDNSEFQQLL NQGIPVAPHTTEPMLMEYPEAITRLVTGAQRPPDPAPAPLGAPGLPNGLLSGDEDFSSIADM DFSALLGSGSGSRDSREGMFLPKPEAGSAISDVFEGREVCQPKRIRPFHPPGSPWANRPLPAS LAPTPTGPVHEPVGSLTPAPVPQPLDPAPAVTPEASHLLEDPDEETSQAVKALREMADTVIP QKEEAAICGQMDLSHPPPRGHLDELTTTLESMTEDLNLDSPLTPELNEILDTFLNDECLLHA MHISTGLSIFDTSLF |
| SEQ ID NO: 310 | MAPKKKRKVGIHGVPAALEPGEKPYKCPECGKSFSRSDNLVRHQRTHTGEKPYKCPECGK SFSHRTTLTNHQRTHTGEKPYKCPECGKSFSREDNLHTHQRTHTGEKPYKCPECGKSFSTSH SLTEHQRTHTGEKPYKCPECGKSFSQSSSLVRHQRTHTGEKPYKCPECGKSFSREDNLHTH QRTHTGKKTSKRPAATKKAGQAKKKKGSYPYDVPDYALEDALDDFDLDMLGSDALDDFD LDMLGSDALDDFDLDMLGSDALDDFDLDML |
| SEQ ID NO: 311 | MAPKKKRKVGIHGVPAALEPGEKPYKCPECGKSFSRRDELNVHQRTHTGEKPYKCPECGK SFSRSDHLTNHQRTHTGEKPYKCPECGKSFSRSDDLVRHQRTHTGEKPYKCPECGKSFSRS DNLVRHQRTHTGEKPYKCPECGKSFSHRTTLTNHQRTHTGEKPYKCPECGKSFSREDNLHT HQRTHTGEKPYKCPECGKSFSTSHSLTEHQRTHTGEKPYKCPECGKSFSQSSSLVRHQRTHT GEKPYKCPECGKSFSREDNLHTHQRTHTGKKTSKRPAATKKAGQAKKKKGSYPYDVPDY ALEEASGSGRADALDDFDLDMLGSDALDDFDLDMLGSDALDDFDLDMLGSDALDDFDLD MLINSRSSGSPKKKRKVGSQYLPDTDDRHRIEEKRKRTYETFKSIMKKSPFSGPTDPRPPPRR IAVPSRSSASVPKPAPQPYPFTSSLSTINYDEFPTMVFPSGQISQASALAPAPPQVLPQAPAPA PAPAMVSALAQAPAPVPVLAPGPPQAVAPPPAPKPTQAGEGTLSEALLQLQFDDEDLGALLG |

TABLE 18-continued

| Sequences of eTFs that upregulate expression of SCN1A | |
|---|---|
| eTF SEQ ID NO: | eTF protein sequences |
| | NSTDPAVFTDLASVDNSEFQQLLNQGIPVAPHTTEPMLMEYPEAITRLVTGAQRPPDPAPAP LGAPGLPNGLLSGDEDFSSIADMDFSALLGSGSGSRDSREGMFLPKPEAGSAISDVFEGREV CQPKRIRPFHPPGSPWANRPLPASLAPTPTGPVHEPVGSLTPAPVPQPLDPAPAVTPEASHLL EDPDEETSQAVKALREMADTVIPQKEEAAICGQMDLSHPPPRGHLDELTTTLESMTEDLNL DSPLTPELNEILDTFLNDECLLHAMHISTGLSIFDTSLF |
| SEQ ID NO: 312 | MAPKKKRKVGIHGVPAALEPGEKPYKCPECGKSFSRRDELNVHQRTHTGEKPYKCPECGK SFSRSDHLTNHQRTHTGEKPYKCPECGKSFSRSDDLVRHQRTHTGEKPYKCPECGKSFSRS DNLVRHQRTHTGEKPYKCPECGKSFSHRTTLTNHQRTHTGEKPYKCPECGKSFSREDNLHT HQRTHTGEKPYKCPECGKSFSTSHSLTEHQRTHTGEKPYKCPECGKSFSQSSSLVRHQRTHT GEKPYKCPECGKSFSREDNLHTHQRTHTGKKTSKRPAATKKAGQAKKKKGSYPYDVPDY ALEDALDDFDLDMLGSDALDDFDLDMLGSDALDDFDLDMLGSDALDDFDLDML |
| SEQ ID NO: 313 | MAAAKAEMQLMSPLQISDPFGSFPHSPTMDNYPKLEEMMLLSNGAPQFLGAAGAPEGSGS NSSSSSSGGGGGGGGGSNSSSSSSTFNPQADTGEQPYEHLTAESFPDISLNNEKVLVETSYPS QTTRLPPITYTGRFSLEPAPNSGNTLWPEPLFSLVSGLVSMTNPPASSSSAPSPAASSASASQS PPLSCAVPSNDSSPIYSAAPTFPTPNTDIFPEPQSQAFPGSAGTALQYPPPAYPAAKGGFQVP MIPDYLFPQQQGDLGLGTPDQKPFQGLESRTQQPSLTPLSTEKAFATQSGSQDLKALNTSYQ SQLIKPSRMRKYPNRPSKTPPHERPYACPVESCDRRFSRSDNLVRHIRIHTGQKPFQCRICMR NFSREDNLHTHIRTHTGEKPFACDICGRKFARSDELVRHTKIHLRQKDRPYACPVESCDRRF SQSGNLTEHIRIHTGQKPFQCRICMRNFSTSGHLVRHIRTHTGEKPFACDICGRKFAQNSTLT EHTKIHLRQKDKKADKSVVASSATSSLSSYPSPVATSYPSPVTTSYPSPATTSYPSPVPTSFSS PGSSTYPSPVHSGFPSPSVATTYSSVPPAFPAQVSSFPSSAVTNSFSASTGLSDMTATFSPRTIE IC |
| SEQ ID NO: 314 | MAAAKAEMQLMSPLQISDPFGSFPHSPTMDNYPKLEEMMLLSNGAPQFLGAAGAPEGSGS NSSSSSSGGGGGGGGGSNSSSSSSTFNPQADTGEQPYEHLTAESFPDISLNNEKVLVETSYPS QTTRLPPITYTGRFSLEPAPNSGNTLWPEPLFSLVSGLVSMTNPPASSSSAPSPAASSASASQS PPLSCAVPSNDSSPIYSAAPTFPTPNTDIFPEPQSQAFPGSAGTALQYPPPAYPAAKGGFQVP MIPDYLFPQQQGDLGLGTPDQKPFQGLESRTQQPSLTPLSTEKAFATQSGSQDLKALNTSYQ SQLIKPSRMRKYPNRPSKTPPHERPYACPVESCDRRFSRSDNLVRHIRIHTGQKPFQCRICMR NFSREDNLHTHIRTHTGEKPFACDICGRKFARSDELVRHTKIHLRQKDRPYACPVESCDRRF SQSGNLTEHIRIHTGQKPFQCRICMRNFSTSGHLVRHIRTHTGEKPFACDICGRKFAQNSTLT EHTKIHLRQKDKKADKSVVASSATSSLSSYPSPVATSYPSPVTTSYPSPATTSYPSPVPTSFSS PGSSTYPSPVHSGFPSPSVATTYSSVPPAFPAQVSSFPSSAVTNSFSASTGLSDMTATFSPRTIE IC |
| SEQ ID NO: 315 | MAADHLMLAEGYRLVQRPPSAAAAHGPHALRTLPPYAGPGLDSGLRPRGAPLGPPPPRQP GALAYGAFGPPSSFQPFPAVPPPAAGIAHLQPVATPYPGRAAAPPNAPGGPPGPQPAPSAAA PPPPAHALGGMDAELIDEEALTSLELELGLHRVRELPELFLGQSEFDCFSDLGSAPPAGSVSC GGSGGGSGQSQLEKPSRMRKYPNRPSKTPPHERPYACPVESCDRRFSRSDNLVRHIRIHTGQ KPFQCRICMRNFSREDNLHTHIRTHTGEKPFACDICGRKFARSDELVRHTKEILRQKDRPYA CPVESCDRRFSQSGNLTEHIRIHTGQKPFQCRICMRNFSTSGHLVRHIRTHTGEKPFACDICG RKFAQNSTLTEHTKEILRQKDK |
| SEQ ID NO: 316 | MAADHLMLAEGYRLVQRPPSAAAAHGPHALRTLPPYAGPGLDSGLRPRGAPLGPPPPRQP GALAYGAFGPPSSFQPFPAVPPPAAGIAHLQPVATPYPGRAAAPPNAPGGPPGPQPAPSAAA PPPPAHALGGMDAELIDEEALTSLELELGLHRVRELPELFLGQSEFDCFSDLGSAPPAGSVSC GGSGGGSGQSQLEKPSRMRKYPNRPSKTPPHERPYACPVESCDRRFSRSDNLVRHIRIHTGQ KPFQCRICMRNFSREDNLHTHIRTHTGEKPFACDICGRKFARSDELVRHTKEILRQKDRPYA CPVESCDRRFSQSGNLTEHIRIHTGQKPFQCRICMRNFSTSGHLVRHIRTHTGEKPFACDICG RKFAQNSTLTEHTKEILRQKDKLEMADHLMLAEGYRLVQRPPSAAAAHGPHALRTLPPYA GPGLDSGLRPRGAPLGPPPPRQPGALAYGAFGPPSSFQPFPAVPPPAAGIAHLQPVATPYPGR AAAPPNAPGGPPGPQPAPSAAAPPPPAHALGGMDAELIDEEALTSLELELGLHRVRELPELF LGQSEFDCFSDLGSAPPAGSVSC |
| SEQ ID NO: 317 | MAAAKAEMQLMSPLQISDPFGSFPHSPTMDNYPKLEEMMLLSNGAPQFLGAAGAPEGSGS NSSSSSSGGGGGGGGGSNSSSSSSTFNPQADTGEQPYEHLTAESFPDISLNNEKVLVETSYPS QTTRLPPITYTGRFSLEPAPNSGNTLWPEPLFSLVSGLVSMTNPPASSSSAPSPAASSASASQS PPLSCAVPSNDSSPIYSAAPTFPTPNTDIFPEPQSQAFPGSAGTALQYPPPAYPAAKGGFQVP MIPDYLFPQQQGDLGLGTPDQKPFQGLESRTQQPSLTPLSTEKAFATQSGSQDLKALNTSYQ SQLIKPSRMRKYPNRPSKTPPHERPYACPVESCDRRFSRSDNLVRHIRIHTGQKPFQCRICMR NFSHRTTLTNHIRTHTGEKPFACDICGRKFAREDNLHTHIRTHTGEKPFACDICGRKFSTSHS LTEHIRIHTGQKPFQCRICMRNFSQSSSLVRHIRTHTGEKPFACDICGRKFAREDNLHTHTKI HLRQKDKKADKSVVASSATSSLSSYPSPVATSYPSPVTTSYPSPATTSYPSPVPTSFSSPGSST YPSPVHSGFPSPSVATTYSSVPPAFPAQVSSFPSSAVTNSFSASTGLSDMTATFSPRTIEIC |
| SEQ ID NO: 318 | MAADHLMLAEGYRLVQRPPSAAAAHGPHALRTLPPYAGPGLDSGLRPRGAPLGPPPPRQP GALAYGAFGPPSSFQPFPAVPPPAAGIAHLQPVATPYPGRAAAPPNAPGGPPGPQPAPSAAA PPPPAHALGGMDAELIDEEALTSLELELGLHRVRELPELFLGQSEFDCFSDLGSAPPAGSVSC GGSGGGSGQSQLEKPSRMRKYPNRPSKTPPHERPYACPVESCDRRFSRSDNLVRHIRIHTGQ KPFQCRICMRNFSHRTTLTNHIRTHTGEKPFACDICGRKFAREDNLHTHTKIHLRQKDRPYA CPVESCDRRFSTSHSLTEHIRHETGQKPFQCRICMRNFSQSSSLVRHIRTHTGEKPFACDICGR KFAREDNLHTHTKIHLRQKDK |

TABLE 18-continued

Sequences of eTFs that upregulate expression of SCN1A

| eTF SEQ ID NO: | eTF protein sequences |
|---|---|
| SEQ ID NO: 319 | MAADHLMLAEGYRLVQRPPSAAAAHGPHALRTLPPYAGPGLDSGLRPRGAPLGPPPPRQP<br>GALAYGAFGPPSSFQPFPAVPPPAAGIAHLQPVATPYPGRAAAPPNAPGGPPGPQPAPSAAA<br>PPPPAHALGGMDAELIDEEALTSLELELGLHRVRELPELFLGQSEFDCFSDLGSAPPAGSVSC<br>GGSGGGSGQSQLEKPSRMRKYPNRPSKTPPHERPYACPVESCDRRFSRSDNLVRHIRIHTGQ<br>KPFQCRICMRNFSHRTTLTNHIRTHTGEKPFACDICGRKFAREDNLHTHTKIHLRQKDRPYA<br>CPVESCDRRFSTSHSLTEHIRHETGQKPFQCRICMRNFSQSSSLVRHIRTHTGEKPFACDICGR<br>KFAREDNLHTHTKIHLRQKDKLEMADHLMLAEGYRLVQRPPSAAAAHGPHALRTLPPYAG<br>PGLDSGLRPRGAPLGPPPPRQPGALAYGAFGPPSSFQPFPAVPPPAAGIAHLQPVATPYPGRA<br>AAPPNAPGGPPGPQPAPSAAAPPPPAHALGGMDAELIDEEALTSLELELGLHRVRELPELFL<br>GQSEFDCFSDLGSAPPAGSVSC |
| SEQ ID NO: 320 | MAAAKAEMQLMSPLQISDPFGSFPHSPTMDNYPKLEEMMLLSNGAPQFLGAAGAPEGSGS<br>NSSSSSSGGGGGGGGSNSSSSSSTFNPQADTGEQPYEHLTAESFPDISLNNEKVLVETSYPS<br>QTTRLPPITYTGRFSLEPAPNSGNTLWPEPLFSLVSGLVSMTNPPASSSSAPSPAASSASASQS<br>PPLSCAVPSNDSSPIYSAAPTFPTPNTDIFPEPQSQAFPGSAGTALQYPPPAYPAAKGGFQVP<br>MIPDYLFPQQQGDLGLGTPDQKPFQGLESRTQQPSLTPLSTEKAFATQSGSQDLKALNTSYQ<br>SQLIKPSRMRKYPNRPSKTPPHERPYACPVESCDRRFSRRDELNVHIRIHTGQKPFQCRICMR<br>NFSRSDHLTNHIRTHTGEKPFACDICGRKFARSDDLVRHTKIHLRQKDRPYACPVESCDRRF<br>SRSDNLVRHIRIHTGQKPFQCRICMRNFSHRTTLTNHIRTHTGEKPFACDICGRKFAREDNLH<br>THTKIHLRQKDRPYACPVESCDRRFSTSHSLTEHIRIHTGQKPFQCRICMRNFSQSSSLVRHIR<br>THTGEKPFACDICGRKFAREDNLHTHTKIHLRQKDKKADKSVVASSATSSLSSYPSPVATSY<br>PSPVTTSYPSPATTSYPSPVPTSFSSPGSSTYPSPVHSGFPSPSVATTYSSVPPAFPAQVSSFPSS<br>AVTNSFSASTGLSDMTATFSPRTIEIC |
| SEQ ID NO: 321 | MAAAKAEMQLMSPLQISDPFGSFPHSPTMDNYPKLEEMMLLSNGAPQFLGAAGAPEGSGS<br>NSSSSSSGGGGGGGGSNSSSSSSTFNPQADTGEQPYEHLTAESFPDISLNNEKVLVETSYPS<br>QTTRLPPITYTGRFSLEPAPNSGNTLWPEPLFSLVSGLVSMTNPPASSSSAPSPAASSASASQS<br>PPLSCAVPSNDSSPIYSAAPTFPTPNTDIFPEPQSQAFPGSAGTALQYPPPAYPAAKGGFQVP<br>MIPDYLFPQQQGDLGLGTPDQKPFQGLESRTQQPSLTPLSTEKAFATQSGSQDLKALNTSYQ<br>SQLIKPSRMRKYPNRPSKTPPHERPYACPVESCDRRFSRRDELNVHIRIHTGQKPFQCRICMR<br>NFSRSDHLTNHIRTHTGEKPFACDICGRKFARSDDLVRHTKIHLRQKDRPYACPVESCDRRF<br>SRSDNLVRHIRIHTGQKPFQCRICMRNFSHRTTLTNHIRTHTGEKPFACDICGRKFAREDNLH<br>THTKIHLRQKDRPYACPVESCDRRFSTSHSLTEHIRIHTGQKPFQCRICMRNFSQSSSLVRHIR<br>THTGEKPFACDICGRKFAREDNLHTHTKIHLRQKDKKADKSVVASSATSSLSSYPSPVATSY<br>PSPVTTSYPSPATTSYPSPVPTSFSSPGSSTYPSPVHSGFPSPSVATTYSSVPPAFPAQVSSFPSS<br>AVTNSFSASTGLSDMTATFSPRTIEIC |
| SEQ ID NO: 322 | MAAAKAEMQLMSPLQISDPFGSFPHSPTMDNYPKLEEMMLLSNGAPQFLGAAGAPEGSGS<br>NSSSSSSGGGGGGGGSNSSSSSSTFNPQADTGEQPYEHLTAESFPDISLNNEKVLVETSYPS<br>QTTRLPPITYTGRFSLEPAPNSGNTLWPEPLFSLVSGLVSMTNPPASSSSAPSPAASSASASQS<br>PPLSCAVPSNDSSPIYSAAPTFPTPNTDIFPEPQSQAFPGSAGTALQYPPPAYPAAKGGFQVP<br>MIPDYLFPQQQGDLGLGTPDQKPFQGLESRTQQPSLTPLSTEKAFATQSGSQDLKALNTSYQ<br>SQLIKPSRMRKYPNRPSKTPPHERPYACPVESCDRRFSRRDELNVHIRIHTGQKPFQCRICMR<br>NFSRSDHLTNHIRTHTGEKPFACDICGRKFARSDDLVRHTKIHLRQKDRPYACPVESCDRRF<br>SRSDNLVRHIRIHTGQKPFQCRICMRNFSHRTTLTNHIRTHTGEKPFACDICGRKFAREDNLH<br>THTKIHLRQKDRPYACPVESCDRRFSTSHSLTEHIRIHTGQKPFQCRICMRNFSQSSSLVRHIR<br>THTGEKPFACDICGRKFAREDNLHTHTKIHLRQKDKKADKSVVASSATSSLSSYPSPVATSY<br>PSPVTTSYPSPATTSYPSPVPTSFSSPGSSTYPSPVHSGFPSPSVATTYSSVPPAFPAQVSSFPSS<br>AVTNSFSASTGLSDMTATFSPRTIEIC |
| SEQ ID NO: 323 | MTGKLAEKLPVTMSSLLNQLPDNLYPEEIPSALNLFSGSSDSVVHYNQMATENVMDIGLTN<br>EKPNPELSYSGSFQPAPGNKTVTYLGKFAFDSPSNWCQDNIISLMSAGILGVPPASGALSTQT<br>STASMVQPPQGDVEAMYPALPPYSNCGDLYSEPVSFHDPQGNPGLAYSPQDYQSAKPALD<br>SNLFPMIPDYNLYHHPNDMGSIPEHKPFQGMDPIRVNPPPITPLETIKAFKDKQH1PGFGSLPQ<br>PPLTLKPIRPRKYPNRPSKTPLHERPHACPAEGCDRRFSRSDNLVRHLRIHTGHKPFQCRICM<br>RSFSREDNLHTHIRTHTGEKPFACEFCGRKFARSDELVRHAKIHLKQKEHACPAEGCDRRFS<br>QSGNLTEHLRIHTGHKPFQCRICMRSFSTSGHLVRHIRTHTGEKPFACEFCGRKFAQNSTLTE<br>HAKEILKQKEKKAEKGGAPSASSAPPVSLAPVVTTCA |
| SEQ ID NO: 324 | MAADHLMLAEGYRLVQRPPSAAAAHGPHALRTLPPYAGPGLDSGLRPRGAPLGPPPPRQP<br>GALAYGAFGPPSSFQPFPAVPPPAAGIAHLQPVATPYPGRAAAPPNAPGGPPGPQPAPSAAA<br>PPPPAHALGGMDAELIDEEALTSLELELGLHRVRELPELFLGQSEFDCFSDLGSAPPAGSVSC<br>QSQLIKPSRMRKYPNRPSKTPPHERPYACPVESCDRRFSRSDNLVRHIRIHTGQKPFQCRICM<br>RNFSHRTTLTNHIRTHTGEKPFACDICGRKFAREDNLHTHTKIHLRQKDRPYACPVESCDRR<br>FSTSHSLTEHIRIHTGQKPFQCRICMRNFSQSSSLVRHIRTHTGEKPFACDICGRKFAREDNLH<br>THTKIHLRQKDK |
| SEQ ID NO: 325 | MAAAKAEMQLMSPLQISDPFGSFPHSPTMDNYPKLEEMMLLSNGAPQFLGAAGAPEGSGS<br>NSSSSSSGGGGGGGGSNSSSSSSTFNPQADTGEQPYEHLTAESFPDISLNNEKVLVETSYPS<br>QTTRLPPITYTGRFSLEPAPNSGNTLWPEPLFSLVSGLVSMTNPPASSSSAPSPAASSASASQS<br>PPLSCAVPSNDSSPIYSAAPTFPTPNTDIFPEPQSQAFPGSAGTALQYPPPAYPAAKGGFQVP<br>MIPDYLFPQQQGDLGLGTPDQKPFQGLESRTQQPSLTPLSTEKAFATQSGSQDLKALNTSYQ<br>SQLIKPSRMRKYPNRPSKTPPHERPYACPVESCDRRFSRSDNLVRHIRIHTGQKPFQCRICMR<br>NFSHRTTLTNHIRTHTGEKPFACDICGRKFAREDNLHTHIRTHTGEKPFACDICGRKFSTSHS |

TABLE 18-continued

| Sequences of eTFs that upregulate expression of SCN1A | |
|---|---|
| eTF SEQ ID NO: | eTF protein sequences |
| | LTEHIRIHTGQKPFQCRICMRNFSQSSSLVRHIRTHTGEKPFACDICGRKFAREDNLHTHTKI<br>HLRQKDKKADKSVVASSATSSLSSYPSPVATSYPSPVTTSYPSPATTSYPSPVPTSFSSPGSST<br>YPSPVHSGFPSPSVATTYSSVPPAFPAQVSSFPSSAVTNSFSASTGLSDMTATFSPRTIEIC |
| SEQ ID NO: 365 | MAPKKKRKVGIHGVPAALEPGEKPYKCPECGKSFSRSDNLVRHQRTHTGEKPYKCPECGK<br>SFSHRTTLTNHQRTHTGEKPYKCPECGKSFSREDNLHTHQRTHTGEKPYKCPECGKSFSTSH<br>SLTEHQRTHTGEKPYKCPECGKSFSQSSSLVRHQRTHTGEKPYKCPECGKSFSREDNLHTH<br>QRTHTGKKTSKRPAATKKAGQAKKKKGSYPYDVPDYALEDALDDFDLDMLGSDALDDFD<br>LDMLGSDALDDFDLDMLGSDALDDFDLDML |
| SEQ ID NO: 366 | MAPKKKRKVGIHGVPAALEPGEKPYKCPECGKSFSRSDNLVRHQRTHTGEKPYKCPECGK<br>SFSHRTTLTNHQRTHTGEKPYKCPECGKSFSREDNLHTHQRTHTGEKPYKCPECGKSFSTSH<br>SLTEHQRTHTGEKPYKCPECGKSFSQSSSLVRHQRTHTGEKPYKCPECGKSFSREDNLHTH<br>QRTHTGKKTSKRPAATKKAGQAKKKKGSYPYDVPDYALEEASGSGRADALDDFDLDMLG<br>SDALDDFDLDMLGSDALDDFDLDMLGSDALDDFDLDMLINSRSSGSPKKKRKVGSQYLPD<br>TDDRHRIEEKRKRTYETFKSEVIKKSPFSGPTDPRPPPRRIAVPSRSSASVPKPAPQPYPFTSSL<br>STINYDEFPTMVFPSGQISQASALAPAPPQVLPQAPAPAPAPAMVSALAQAPAPVPVLAPGP<br>PQAVAPPAPKPTQAGEGTLSEALLQLQFDDEDLGALLGNSTDPAVFTDLASVDNSEFQQLL<br>NQGIPVAPHTTEPMLMEYPEAITRLVTGAQRPPDPAPAPLGAPGLPNGLLSGDEDFSSIADM<br>DFSALLGSGSGSRDSREG1VIFLPKPEAGSAISDVFEGREVCQPKRIRPFHPPGSPWANRPLPAS<br>LAPTPTGPVHEPVGSLTPAPVPQPLDPAPAVTPEASHLLEDPDEETSQAVKALREMADTVIP<br>QKEEAAICGQMDLSHPPPRGHLDELTTTLESMTEDLNLDSPLTPELNEILDTFLNDECLLHA<br>MEISTGLSIFDTSLF |
| SEQ ID NO: 364 | MYPYDVPDYAGYPYDVPDYAGSYPYDVPDYAGSGSGSAAAKAEMQLMSPLQISDPFGSFP<br>HSPTMDNYPKLEEMMLLSNGAPQFLGAAGAPEGSGSNSSSSSSGGGGGGGGGSNSSSSST<br>FNPQADTGEQPYEHLTAESFPDISLNNEKVLVETSYPSQTTRLPPITYTGRFSLEPAPNSGNTL<br>WPEPLFSLVSGLVSMTNPPASSSSAPSPAASSASASQSPPLSCAVPSNDSSPIYSAAPTFPTPN<br>TDIFPEPQSQAFPGSAGTALQYPPPAYPAAKGGFQVPMIPDYLFPQQQGDLGLGTPDQKPFQ<br>GLESRTQQPSLTPLSTIKAFATQSGSQDLKALNTSYQSQLIKPSRMRKYPNRPSKTPPHERPY<br>ACPVESCDRRFSRSDNLVRHIRIHTGQKPFQCRICMRNFSHRTTLTNHIRTHTGEKPFACDIC<br>GRKFAREDNLHTHTKEILRQKDRPYACPVESCDRRFSTSHSLTEHIRIHTGQKPFQCRICMR<br>NFSQSSSLVRHIRTHTGEKPFACDICGRKFAREDNLHTHTKIHLRQKDKKADKSVVASSATS<br>SLSSYPSPVATSYPSPVTTSYPSPATTSYPSPVPTSFSSPGSSTYPSPVHSGFPSPSVATTYSSVP<br>PAFPAQVSSFPSSAVTNSFSASTGLSDMTATFSPRTIEIC |
| SEQ ID NO: 295 | MYPYDVPDYAGYPYDVPDYAGSYPYDVPDYAGSGSGSAAAKAEMQLMSPLQISDPFGSFP<br>HSPTMDNYPKLEEMMLLSNGAPQFLGAAGAPEGSGSNSSSSSSGGGGGGGGGSNSSSSST<br>FNPQADTGEQPYEHLTAESFPDISLNNEKVLVETSYPSQTTRLPPITYTGRFSLEPAPNSGNTL<br>WPEPLFSLVSGLVSMTNPPASSSSAPSPAASSASASQSPPLSCAVPSNDSSPIYSAAPTFPTPN<br>TDIFPEPQSQAFPGSAGTALQYPPPAYPAAKGGFQVPMIPDYLFPQQQGDLGLGTPDQKPFQ<br>GLESRTQQPSLTPLSTIKAFATQSGSQDLKALNTSYQSQLIKPSRMRKYPNRPSKTPPHERPY<br>ACPVESCDRRFSRSDNLVRHIRIHTGQKPFQCRICMRNFSREDNLHTHIRTHTGEKPFACDIC<br>GRKFARSDELVRHTKIHLRQKDRPYACPVESCDRRFSQSGNLTEHIRIHTGQKPFQCRICMR<br>NFSTSGHLVRHIRTHTGEKPFACDICGRKFAQNSTLTEHTKIHLRQKDKKADKSVVASSATS<br>SLSSYPSPVATSYPSPVTTSYPSPATTSYPSPVPTSFSSPGSSTYPSPVHSGFPSPSVATTYSSVP<br>PAFPAQVSSFPSSAVTNSFSASTGLSDMTATFSPRTIEIC |
| SEQ ID NO: 296 | MAAAKAEMQLMSPLQISDPFGSFPHSPTMDNYPKLEEMMLLSNGAPQFLGAAGAPEGSGS<br>NSSSSSSGGGGGGGGGSNSSSSSSTFNPQADTGEQPYEHLTAESFPDISLNNEKVLVETSYPS<br>QTTRLPPITYTGRFSLEPAPNSGNTLWPEPLFSLVSGLVSMTNPPASSSSAPSPAASSASASQS<br>PPLSCAVPSNDSSPIYSAAPTFPTPNTDIFPEPQSQAFPGSAGTALQYPPPAYPAAKGGFQVP<br>MIPDYLFPQQQGDLGLGTPDQKPFQGLESRTQQPSLTPLSTIKAFATQSGSQDLKALNTSYQ<br>SQLIKPSRMRKYPNRPSKTPPHERPYACPVESCDRRFSDPGALVRHIRIHTGQKPFQCRICMR<br>NFSRSDNLVRHIRTHTGEKPFACDICGRKFAQSGDLRRHTKIHLRQKDRPYACPVESCDRRF<br>STHLDLIRHIRIHTGQKPFQCRICMRNFSTSGNLVRHIRTHTGEKPFACDICGRKFARSDNLV<br>RHTKIHLRQKDRPYACPVESCDRRFSQSGHLTEHIRIHTGQKPFQCRICMRNFSERSHLREHI<br>RTHTGEKPFACDICGRKFAQAGHLASHTKIHLRQKDKKADKSVVASSATSSLSSYPSPVATS<br>YPSPVTTSYPSPATTSYPSPVPTSFSSPGSSTYPSPVHSGFPSPSVATTYSSVPPAFPAQVSSFPS<br>SAVTNSFSASTGLSDMTATFSPRTIEIC |
| SEQ ID NO: 297 | MRKYPNRPSKTPPHERPYACPVESCDRRFSRSDNLTRHIRIHTGQKPFQCRICMRNFSHSTTL<br>TNHIRTHTGEKPFACDICGRKFARSDNRKTHIRTHTGEKPFACDICGRKFSTSHSLTEHIRIHT<br>GQKPFQCRICMRNFSQSSSLTRHIRTHTGEKPFACDICGRKFARSDNRKTHTKIHLRQKDKK<br>ADKSVVAS |
| SEQ ID NO: 298 | MRKYPNRPSKTPPHERPYACPVESCDRRFSRSDNLTRHIRIHTGQKPFQCRICMRNFSRSDN<br>LTTHIRTHTGEKPFACDICGRKFARSDERKRHIRTHTGEKPFACDICGRKFSQSGNLTEHIRIH<br>TGQKPFQCRICMRNFSTSGHLTRHIRTHTGEKPFACDICGRKFAQSSTRKEHTKIHLRQKDK<br>KADKSVVAS |
| SEQ ID NO: 299 | MAAAKAEMQLMSPLQISDPFGSFPHSPTMDNYPKLEEMMLLSNGAPQFLGAAGAPEGSGS<br>NSSSSSSGGGGGGGGGSNSSSSSSTFNPQADTGEQPYEHLTAESFPDISLNNEKVLVETSYPS<br>QTTRLPPITYTGRFSLEPAPNSGNTLWPEPLFSLVSGLVSMTNPPASSSSAPSPAASSASASQS<br>PPLSCAVPSNDSSPIYSAAPTFPTPNTDIFPEPQSQAFPGSAGTALQYPPPAYPAAKGGFQVP<br>MIPDYLFPQQQGDLGLGTPDQKPFQGLESRTQQPSLTPLSTEKAFATQSGSQDLKALNTSYQ |

TABLE 18-continued

Sequences of eTFs that upregulate expression of SCN1A

| eTF SEQ ID NO: | eTF protein sequences |
|---|---|
| | SQLIKPSRMRKYPNRPSKTPPHERPYACPVESCDRRFSRSDNLVRHIRIHTGQKPFQCRICMR<br>NFSREDNLHTHIRTHTGEKPFACDICGRKFARSDELVRHIRTHTGEKPFACDICGRKFSQSGN<br>LTEHIRIHTGQKPFQCRICMRNFSTSGHLVRHIRTHTGEKPFACDICGRKFAQNSTLTEHTKI<br>HLRQKDKKADKSVVASSATSSLSSYPSPVATSYPSPVTTSYPSPATTSYPSPVPTSFSSPGSST<br>YPSPVHSGFPSPSVATTYSSVPPAFPAQVSSFPSSAVTNSFSASTGLSDMTATFSPRTIEIC |
| SEQ ID NO: 440 | MAAAKAEMQLMSPLQISDPFGSFPHSPTMDNYPKLEEMMLLSNGAPQFLGAAGAPEGSGS<br>NSSSSSGGGGGGGGGSNSSSSSSTFNPQADTGEQPYEHLTAESFPDISLNNEKVLVETSYPS<br>QTTRLPPITYTGRFSLEPAPNSGNTLWPEPLFSLVSGLVSMTNPPASSSSAPSPAASSASASQS<br>PPLSCAVPSNDSSPIYSAAPTFPTPNTDIFPEPQSQAFPGSAGTALQYPPPAYPAAKGGFQVP<br>MIPDYLFPQQQGDLGLGTPDQKPFQGLESRTQQPSLTPLSTEKAFATQSGSQDLKALNTSYQ<br>SQLIKPSRMRKYPNRPSKTPPHERPYACPVESCDRRFSRSDNLVRHIRIHTGQKPFQCRICMR<br>NFSREDNLHTHIRTHTGEKPFACDICGRKFARSDELVRHIRTHTGEKPFACDICGRKFSQSGN<br>LTEHIRIHTGQKPFQCRICMRNFSTSGHLVRHIRTHTGEKPFACDICGRKFAQNSTLTEHTKI<br>HLRQKDKKADKSVVASSATSSLSSYPSPVATSYPSPVTTSYPSPATTSYPSPVPTSFSSPGSST<br>YPSPVHSGFPSPSVATTYSSVPPAFPAQVSSFPSSAVTNSFSASTGLSDMTATFSPRTIEIC |

TABLE 19 poly A sequences disclosed herein

| | PolyA sequence |
|---|---|
| SEQ ID NO: 326<br>spA (synthetic poly A) | AATAAAAGATCTTTATTTTCATTAGATCTGTGTGTTGGTTTTTTGTGTGCGGACC<br>GCACGTG |
| SEQ ID NO: 327<br>hGH (human growth<br>hormone poly A) | GGGTGGCATCCCTGTGACCCCTCCCCAGTGCCTCTCCTGGCCCTGGAAGTTGCCA<br>CTCCAGTGCCCACCAGCCTTGTCCTAATAAAATTAAGTTGCATCATTTTGTCTGA<br>CTAGGTGTCCTTCTATAATATTATGGGGTGGAGGGGGTGGTATGGAGCAAGGG<br>GCAAGTTGGGAAGACAACCTGTAGGGCCTGCGGGGTCTATTGGGAACCAAGCTG<br>GAGTGCAGTGGCACAATCTTGGCTCACTGCAATCTCCGCCTCCTGGGTTCAAGC<br>GATTCTCCTGCCTCAGCCTCCCGAGTTGTTGGGATTCCAGGCATGCATGACCAGG<br>CTCAGCTAATTTTTGTTTTTTGGTAGAGACGGGGTTTCACCATATTGGCCAGGC<br>TGGTCTCCAACTCCTAATCTCAGGTGATCTACCCACCTTGGCCTCCCAAATTGCT<br>GGGATTACAGGCGTGAACCACTGCTCCCTTCCCTGTCCTT |

TABLE 20

Examples of zinc fingers for modulating expression of the endogenous GRN gene

| | Amino Acid Sequence | | Amino Acid Sequence | | Amino Acid Sequence | | Amino Acid Sequence |
|---|---|---|---|---|---|---|---|
| SEQ ID NO: 141 | RNDTLTE | SEQ ID NO: 153 | RSDKLVR | SEQ ID NO: 147 | DPGALVR | SEQ ID NO: 159 | REDNLHT |
| SEQ ID NO: 142 | RSDNLVR | SEQ ID NO: 154 | QLAHLRA | SEQ ID NO: 148 | DPGHLVR | SEQ ID NO: 160 | TKNSLTE |
| SEQ ID NO: 143 | RSDHLTT | SEQ ID NO: 155 | ERSHLRE | SEQ ID NO: 149 | RSDELVR | SEQ ID NO: 161 | RKDNLKN |
| SEQ ID NO: 144 | SPADLTR | SEQ ID NO: 156 | TTGNLTV | SEQ ID NO: 150 | DSGNLRV | SEQ ID NO: 162 | QSSNLVR |
| SEQ ID NO: 145 | TSHSLTE | SEQ ID NO: 157 | QRANLRA | SEQ ID NO: 151 | HKNALQN | SEQ ID NO: 163 | QSSSLVR |
| SEQ ID NO: 146 | QSGDLRR | SEQ ID NO: 158 | SKKALTE | SEQ ID NO: 152 | TSGELVR | SEQ ID NO: 164 | QAGHLAS |

TABLE 21

Examples of DBDs of eTFs that modulate expression of GRN, comprising a plurality of ZFs

| | Amino Acid Sequence |
|---|---|
| SEQ ID NO: 165 | LEPGEKPYKCPECGKSFSRNDTLTEHQRTHTGEKPYKCPECGKSFSDPGALVRHQRTHTGEKP<br>YKCPECGKSFSTSGELVRHQRTHTGEKPYKCPECGKSFSRSDNLVRHQRTHTGEKPYKCPECG<br>KSFSTSGELVRHQRTHTGEKPYKCPECGKSFSTKNSLTEHQRTHTGKKTS |

TABLE 21-continued

Examples of DBDs of eTFs that modulate expression of GRN, comprising a plurality of ZFs

| | Amino Acid Sequence |
|---|---|
| SEQ ID NO: 166 | LEPGEKPYKCPECGKSFSRSDNLVRHQRTHTGEKPYKCPECGKSFSDPGHLVRHQRTHTGEKP YKCPECGKSFSRSDHLTTHQRTHTGEKPYKCPECGKSFSRSDELVRHQRTHTGEKPYKCPECG KSFSRSDKLVRHQRTHTGEKPYKCPECGKSFSTTGNLTVHQRTHTGKKTS |
| SEQ ID NO: 167 | LEPGEKPYKCPECGKSFSRSDHLTTHQRTHTGEKPYKCPECGKSFSRSDELVRHQRTHTGEKPY KCPECGKSFSRSDKLVRHQRTHTGEKPYKCPECGKSFSTTGNLTVHQRTHTGEKPYKCPECGK SFSQLAHLRAHQRTHTGEKPYKCPECGKSFSTKNSLTEHQRTHTGKKTS |
| SEQ ID NO: 168 | LEPGEKPYKCPECGKSFSSPADLTRHQRTHTGEKPYKCPECGKSFSDSGNLRVHQRTHTGEKP YKCPECGKSFSQLAHLRAHQRTHTGEKPYKCPECGKSFSQRANLRAHQRTHTGEKPYKCPEC GKSFSREDNLHTHQRTHTGEKPYKCPECGKSFSRSDNLVRHQRTHTGKKTS |
| SEQ ID NO: 169 | LEPGEKPYKCPECGKSFSTSHSLTEHQRTHTGEKPYKCPECGKSFSHKNALQNHQRTHTGEKP YKCPECGKSFSERSHLREHQRTHTGEKPYKCPECGKSFSSKKALTEHQRTHTGEKPYKCPECG KSFSQRANLRAHQRTHTGEKPYKCPECGKSFSRKDNLKNHQRTHTGEKPYKCPECGKSFSQSS NLVRHQRTHTGEKPYKCPECGKSFSQSSSLVRHQRTHTGEKPYKCPECGKSFSQAGHLASHQR THTGKKTS |
| SEQ ID NO: 170 | LEPGEKPYKCPECGKSFSQSGDLRRHQRTHTGEKPYKCPECGKSFSSPADLTRHQRTHTGEKP YKCPECGKSFSDSGNLRVHQRTHTGEKPYKCPECGKSFSQLAHLRAHQRTHTGEKPYKCPECG KSFSQRANLRAHQRTHTGEKPYKCPECGKSFSREDNLHTHQRTHTGEKPYKCPECGKSFSRSD NLVRHQRTHTGKKTS |
| SEQ ID NO: 171 | RNDTLTE x DPGALVR x TSGELVR x RSDNLVR x TSGELVR x TKNSLTE (wherein X indicates a linker comprising 1-50 amino acid residues) |
| SEQ ID NO: 412 | RSDNLVR x DPGHLVR x RSDHLTT x RSDELVR x RSDKLVR x TTGNLTV (wherein X indicates a linker comprising 1-50 amino acid residues) |
| SEQ ID NO: 413 | RSDHLTT x RSDELVR x RSDKLVR x TTGNLTV x QLAHLRA x TKNSLTE (wherein X indicates a linker comprising 1-50 amino acid residues) |
| SEQ ID NO: 414 | SPADLTR x DSGNLRV x QLAHLRA x QRANLRA x REDNLHT x RSDNLVR (wherein X indicates a linker comprising 1-50 amino acid residues) |
| SEQ ID NO: 415 | TSHSLTE x HKNALQN x ERSHLRE x SKKALTE x QRANLRA x RKDNLKN x QSSNLVR x QSSSLVR x QAGHLAS (wherein X indicates a linker comprising 1-50 amino acid residues) |
| SEQ ID NO: 416 | QSGDLRR x SPADLTR x DSGNLRV x QLAHLRA x QRANLRA x REDNLHT x RSDNLVR (wherein X indicates a linker comprising 1-50 amino acid residues) |

TABLE 22

Examples of target site sequences for modulating expression of GRN

| Target site SEQ ID NO: | ZF or gRNA that recognizes the target site | Target site sequence | chr17 start coordinates |
|---|---|---|---|
| SEQ ID NO: 38 | ZF | GAGTAGAAAAGAAACACA | 44345153 |
| SEQ ID NO: 330 | ZF | CGCACTGTCAATGCCCCA | 44344963 |
| SEQ ID NO: 331 | ZF | CCTGCTGAGGCTGTCCCG | 44345058 |
| SEQ ID NO: 332 | ZF | AATGGGGTGTGGGCGAG | 44345111 |
| SEQ ID NO: 333 | ZF | CCTAGAAATGGGGTGTGG | 44345105 |
| SEQ ID NO: 334 | ZF | TGAGTAGAAAAGAAACACAGCATTCCA | 44345152 |
| SEQ ID NO: 335 | ZF | GAGTAGAAAAGAAACACAGCA | 44345153 |
| SEQ ID NO: 336 | ZF | AGTAGAAAAGAAACACAGCAT | 44345154 |
| SEQ ID NO: 113 | gRNA | CATGATCCCTAGAAATGGGGT | 44345098 |

TABLE 23

Examples of eTFs that modulate expression of GRN

| Expression Cassette | Target Site SEQ ID NO: | DBD SEQ ID NO: | TAD SEQ ID NO: | Regulatory Element SEQ ID NO: |
|---|---|---|---|---|
| Control | N/A | None | None | SEQ ID NO: 178 |
| A | SEQ ID NO: 331 | SEQ ID NO: 165 | SEQ ID NO: 95 | SEQ ID NO: 178 |
| B | SEQ ID NO: 331 | SEQ ID NO: 165 | SEQ ID NO: 114 | SEQ ID NO: 178 |
| C | SEQ ID NO: 332 | SEQ ID NO: 166 | SEQ ID NO: 95 | SEQ ID NO: 178 |
| D | SEQ ID NO: 333 | SEQ ID NO: 167 | SEQ ID NO: 95 | SEQ ID NO: 178 |
| E | SEQ ID NO: 333 | SEQ ID NO: 167 | SEQ ID NO: 114 | SEQ ID NO: 178 |
| F | SEQ ID NO: 38 | SEQ ID NO: 168 | SEQ ID NO: 95 | SEQ ID NO: 178 |
| G | SEQ ID NO: 38 | SEQ ID NO: 168 | SEQ ID NO: 114 | SEQ ID NO: 178 |
| H | SEQ ID NO: 334 | SEQ ID NO: 169 | SEQ ID NO: 114 | SEQ ID NO: 178 |
| I | SEQ ID NO: 335 | SEQ ID NO: 170 | SEQ ID NO: 114 | SEQ ID NO: 179 |
| J (K + eGFP) | SEQ ID NO: 38 | SEQ ID NO: 168 | SEQ ID NO: 95 | SEQ ID NO: 179 |
| K | SEQ ID NO: 38 | SEQ ID NO: 168 | SEQ ID NO: 95 | SEQ ID NO: 179 |
| L | SEQ ID NO: 38 | SEQ ID NO: 168 | SEQ ID NO: 114 | SEQ ID NO: 179 |
| M | SEQ ID NO: 113 | SEQ ID NO: 112 | SEQ ID NO: 95 | SEQ ID NO: 178 |

TABLE 24

Examples of regulatory elements (RE) disclosed herein

| | Type of RE | Sequence |
|---|---|---|
| SEQ ID NO: 178 | Intronic | GTGTGTATGCTCAGGGGCTGGGAAAGGAGGGGAGGGAGCTCCGGCTCAG |
| SEQ ID NO: 179 | CBA promoter | CGTTACATAACTTACGGTAAATGGCCCGCCTGGCTGACCGCCCAACGACCCC<br>CGCCCATTGACGTCAATAATGACGTATGTTCCCATAGTAACGCCAATAGGGA<br>CTTTCCATTGACGTCAATGGGTGGAGTATTTACGGTAAACTGCCCACTTGGC<br>AGTACATCAAGTGTATCATATGCCAAGTACGCCCCCTATTGACGTCAATGAC<br>GGTAAATGGCCCGCCTGGCATTATGCCCAGTACATGACCTTATGGGACTTTC<br>CTACTTGGCAGTACATCTACGTATTAGTCATCGCTATTACCATGGTCGAGG<br>TGAGCCCCACGTTCTGCTTCACTCTCCCCATCTCCCCCCCTCCCCACCCCCA<br>ATTTTGTATTTATTTATTTTTAATTATTTTGTGCAGCGATGGGGGCGGGGGG<br>GGGGGGGGCGCGCGCCAGGCGGGGCGGGGCGGGGCGAGGGGCGGGGCGGG<br>GCGAGGCGGAGAGGTGCGGCGGCAGCCAATCAGAGCGGCGCGCTCCGAAA<br>GTTTCCTTTTATGGCGAGGCGGCGGCGGCGGCGGCCCTATAAAAAGCGAAG<br>CGCGCGGCGGGCGGGAGTCGCTGCGTTGCCTTCGCCCCGTGCCCCGCTCCGC<br>GCCGCCTCGCGCCGCCCGCCCCGGCTCTGACTGACCGCGTTACTCCCACAGG<br>TGAGCGGGCGGGACGGCCCTTCTCCTCCGGGCTGTAATTAGCGCTTGGTTTA<br>ATGACGGCTCGTTTCTTTTCTGTGGCTGCGTGAAAGCCTTAAAGGGCTCCGG<br>GAGGGCCCTTTGTGCGGGGGGGAGCGGCTCGGGGGGTGCGTGCGTGTGTGT<br>GTGCGTGGGGAGCGCCGCGTGCGGCCCGCGCTGCCCGGCGGCTGTGAGCGC<br>TGCGGGCGCGGCGCGGGGCTTTGTGCGCTCCGCGTGTGCGCGAGGGGAGCG<br>CGGCCGGGGGCGGTGCCCCGCGGTGCGGGGGGGCTGCGAGGGGAACAAAG<br>GCTGCGTGCGGGGTGTGTGCGTGGGGGGGTGAGCAGGGGGTGTGGGCGCGG<br>CGGTCGGGCTGTAACCCCCCCCTGCACCCCCCTCCCCGAGTTGCTGAGCACG<br>GCCCGGCTTCGGGTGCGGGGCTCCGTGCGGGGCGTGGCGCGGGGCTCGCCG<br>TGCCGGGCGGGGGTGGCGGCAGGTGGGGGTGCCGGGCGGGGCGGGGCCG<br>CCTCGGGCCGGGGAGGGCTCGGGGGAGGGGCGCGGCGGCCCCGGAGCGCC<br>GGCGGCTGTCGAGGCGCGGCGAGCCGCAGCCATTGCCTTTTATGGTAATCGT<br>GCGAGAGGGCGCAGGGACTTCCTTTGTCCCAAATCTGGCGGAGCCGAAATC<br>TGGGAGGCGCCGCCGCACCCCCTCTAGCGGGCGCGGGCGAAGCGGTGCGGC<br>GCCGGCAGGAAGGAAATGGGCGGGGAGGGCCTTCGTCGTCGCCGCGCCGC<br>CGTCCCCTTCTCCATCTCCAGCCTCGGGGCTGCCGCAGGGGGACGGCTGCCT<br>TCGGGGGGGACGGGGCAGGGCGGGGTTCGGCTTCTGGCGTGTGACCGGCGG<br>CTCTAGAGCCTCTGCTAACCATGTTCATGCCTTCTTCTTTTTCCTACAGCTCC<br>TGGGCAACGTGCTGGTTGTTGTGCTGTCTCATCATTTTGGCAAAGAATT |
| SEQ ID NO: 182 | Intronic | GTAAGGTAAGAATTGAATTTCTCAGTTGAAGGATGCTTACACTCTTGTCCAT<br>CTAG |
| SEQ ID NO: 183 | Parvalbumin (PV)-selective | GGAGGAAGCCATCAACTAAACTACAATGACTGTAAGATACAAAATTGGGAA<br>TGGTAACATATTTTGAAGTTCTGTTGACATAAAGAATCATGATATTAATGCC<br>CATGGAAATGAAAGGGCGATCAACACTATGGTTTGAAAAGGGGAAATTGT<br>AGAGCACAGATGTGTTCGTGTGGCAGTGTGCTGTCTCTAGCAATACTCAGAG<br>AAGAGAGAACAATGAAATTCTGATTGGCCCCAGTGTGAGCCCAGATGAG<br>GTTCAGCTGCCAACTTTCTCTTTCACATCTTATGAAAGTCATTTAAGCACAAC<br>TAACTTTTTTTTTTTTTTTTTTTGAGACAGAGTCTTGCTCTGTTGCCCAG<br>GACAGAGTGCAGTAGTGACTCAATCTCGGCTCACTGCAGCCTCCACCTCCTA<br>GGCTCAAACGGTCCTCCTGCATCAGCCTCCCAAGTAGCTGGAATTACAGGA<br>GTGGCCCACCATGCCCAGCTAATTTTTGTATTTTTAATAGATACGGGGTTT<br>CACCATATCACCCAGGCTGGTCTCGAACTCCTGGCCTCAAGTGATCCACCTG |

TABLE 24-continued

Examples of regulatory elements (RE) disclosed herein

| Type of RE | Sequence |
|---|---|
| | CCTCGGCCTCCCAAAGTGCTGGGATTATAGGCGTCAGCCACTATGCCCAACC<br>CGACCAACCTTTTTTAAAATAAATATTTAAAAAATTGGTATTTCACATATAT<br>ACTAGTATTTACATTTATCCACACAAAACGGACGGGCCTCCGCTGAACCAGT<br>GAGGCCCCAGACGTGCGCATAAATAACCCCTGCGTGCTGCACCACCTGGGG<br>AGAGGGGGAGGACCACGGTAAATGGAGCGAGCGCATAGCAAAAGGGACGC<br>GGGGTCCTTTTCTCTGCCGGTGGCACTGGGTAGCTGTGGCCAGGTGTGGTAC<br>TTTGATGGGGCCCAGGGCTGGAGCTCAAGGAAGCGTCGCAGGGTCACAGAT<br>CTGGGGGAACCCCGGGGAAAAGCACTGAGGCAAAACCGCCGCTCGTCTCCT<br>ACAATATATGGGAGGGGGAGGTTGAGTACGTTCTGGATTACTCATAAGACC<br>TTTTTTTTTTCCTTCCGGGCGCAAAACCGTGAGCTGGATTTATAATCGCCCTA<br>TAAAGCTCCAGAGGCGGTCAGGCACCTGCAGAGGAGCCCCGCCGCTCCGCC<br>GACTAGCTGCCCCCGCGAGCAACGGCCTCGTGATTTCCCCGCCGATCCGGTC<br>CCCGCCTCCCCACTCTGCCCCCGCCTACCCCGGAGCCGTGCAGCCGCCTCTC<br>CGAATCTCTCTCTTCTCCTGGCGCTCGCGTGCGAGAGGGAACTAGCGAGAAC<br>GAGGAAGCAGCTGGAGGTGACGCCGGGCAGATTACGCCTGTCAGGGCCGAG<br>CCGAGCGGATCGCTGGGCGCTGTGCAGAGGAAAGGCGGGAGTGCCCGGCTC<br>GCTGTCGCAGAGCCGAGGTGGGTAAGCTAGCGACCACCTGGACTTCCCAGC<br>GCCCAACCGTGGCTTTTCAGCCAGGTCCTCTCCTCCCGCGGCTTCTCAACCA<br>ACCCCATCCCAGCGCCGGCCACCCAACCTCCCGAAATGAGTGCTTCCTGCCC<br>CAGCAGCCGAAGGCGCTACTAGGAACGGTAACCTGTTACTTTTCCAGGGGC<br>CGTAGTCGACCCGCTGCCCGAGTTGCTGTGCGACTGCGCGCGCGGGGCTAG<br>AGTGCAAGGTGACTGTGGTTCTTCTCTGGCCAAGTCCGAGGGAGAACGTAA<br>AGATATGGGCCTTTTTCCCCCTCTCACCTTGTCTCACCAAAGTCCCTAGTCCC<br>CGGAGCAGTTAGCCTCTTTCTTTCCAGGGAATTAGCCAGACACAACAACGG<br>GAACCAGACACCGAACCAGACATGCCCGCCCCGTGCGCCCTCCCCGCTCGC<br>TGCCTTTCCTCCCTCTTGTCTCTCCAGAGCCGGATCTTCAAGGGGAGCCTCCG<br>TGCCCCCGGCTGCTCAGTCCCTCCGGTGTGCAGGACCCCGGAAGTCCTCCCC<br>GCACAGCTCTCGCTTCTCTTTGCAGCCTGTTTCTGCGCCGGACCAGTCGAGG<br>ACTCTGGACAGTAGAGGCCCCGGGACGACCGAGCTG |
| SEQ ID NO: 184 | Parvalbumin (PV)-selective | TCAACAGGGGGACACTTGGGAAAGAAGGATGGGGACAGAGCCGAGAGGAC<br>TGTTACACATTAGAGAAACATCAGTGACTGTGCCAGCTTTGGGGTAGACTGC<br>ACAAAAGCCCTGAGGCAGCACAGGCAGGATCCAGTCTGCTGGTCCCAGGAA<br>GCTAACCGTCTCAGACAGAGCACAAAGCACCGAGACATGTGCCACAAGGCT<br>TGTGTAGAGAGGTCAGAGGACAGCGTACAGGTCCCAGAGATCAAACTCAAC<br>CTCACCAGGCTTGGCAGCAAGCCTTTACCAACCCACCCCCACCCCACCCACC<br>CTGCACGCGCCCTCTCCCCTCCCCATGGTCTCCCATGGCTATCTCACTTGGC<br>CCTAAAATGTTTAAGGATGACACTGGCTGCTGAGTGGAAATGAGACAGCAG<br>AAGTCAACAGTAGATTTTAGGAAAGCCAGAGAAAAAGGCTTGTGCTGTTTT<br>TAGAAAGCCAAGGGACAAGCTAAGATAGGGCCCAAGTAATGCTAGTATTTA<br>CATTTATCCACACAAAACGGACGGGCCTCCGCTGAACCAGTGAGGCCCCAG<br>ACGTGCGCATAAATAACCCCTGCGTGCTGCACCACCTGGGGAGAGGGGGAG<br>GACCACGGTAAATGGAGCGAGCGCATAGCAAAAGGGACGCGGGGTCCTTTT<br>CTCTGCCGGTGGCACTGGGTAGCTGTGGCCAGGTGTGGTACTTTGATGGGGC<br>CCAGGGCTGGAGCTCAAGGAAGCGTCGCAGGGTCACAGATCTGGGGGAACC<br>CCGGGGAAAAGCACTGAGGCAAAACCGCCGCTCGTCTCCTACAATATATGG<br>GAGGGGGAGGTTGAGTACGTTCTGGATTACTCATAAGACCTTTTTTTTTTCCT<br>TCCGGGCGCAAAACCGTGAGCTGGATTTATAATCGCCCTATAAAGCTCCAG<br>AGGCGGTCAGGCACCTGCAGAGGAGCCCCGCCGCTCCGCCGACTAGCTGCC<br>CCCGCGAGCAACGGCCTCGTGATTTCCCCGCCGATCCGGTCCCCGCCTCCCC<br>ACTCTGCCCCCGCCTACCCCGGAGCCGTGCAGCCGCCTCTCCGAATCTCTCT<br>CTTCTCCTGGCGCTCGCGTGCGAGAGGGAACTAGCGAGAACGAGGAAGCAG<br>CTGGAGGTGACGCCGGGCAGATTACGCCTGTCAGGGCCGAGCCGAGCGGAT<br>CGCTGGGCGCTGTGCAGAGGAAAGGCGGGAGTGCCCGGCTCGCTGTCGCAG<br>AGCCGAGGTGGGTAAGCTAGCGACCACCTGGACTTCCCAGCGCCCAACCGT<br>GGCTTTTCAGCCAGGTCCTCTCCTCCCGCGGCTTCTCAACCAACCCCATCCC<br>AGCGCCGGCCACCCAACCTCCCGAAATGAGTGCTTCCTGCCCCAGCAGCCG<br>AAGGCGCTACTAGGAACGGTAACCTGTTACTTTTCCAGGGGCCGTAGTCGAC<br>CCGCTGCCCGAGTTGCTGTGCGACTGCGCGCGCGGGGCTAGAGTGCAAGGT<br>GACTGTGGTTCTTCTCTGGCCAAGTCCGAGGGAGAACGTAAAGATATGGGC<br>CTTTTTCCCCCTCTCACCTTGTCTCACCAAAGTCCCTAGTCCCCGGAGCAGTT<br>AGCCTCTTTCTTTCCAGGGAATTAGCCAGACACAACAACGGGAACCAGACA<br>CCGAACCAGACATGCCCGCCCCGTGCGCCCTCCCCGCTCGCTGCCTTTCCTC<br>CCTCTTGTCTCTCCAGAGCCGGATCTTCAAGGGGAGCCTCCGTGCCCCCGGC<br>TGCTCAGTCCCTCCGGTGTGCAGGACCCCGGAAGTCCTCCCCGCACAGCTCT<br>CGCTTCTCTTTGCAGCCTGTTTCTGCGCCGGACCAGTCGAGGACTCTGGACA<br>GTAGAGGCCCCGGGACGACCGAGCTG |
| SEQ ID NO: 185 | Parvalbumin (PV)-selective | GGAGGAAGCCATCAACTAAACTACAATGACTGTAAGATACAAAATTGGGAA<br>TGGTAACATATTTTGAAGTTCTGTTGACATAAAGAATCATGATATTAATGCC<br>CATGGAAATGAAAGGGCGATCAACACTATGGTTTGAAAAGGGGGAAATTGT<br>AGAGCACAGATGTGTTCGTGTGGCAGTGTGCTGTCTCTAGCAATACTCAGAG<br>AAGAGAGAGAACAATGAAATTCTGATTGGCCCAGTGTGAGCCCAGATGAG<br>GTTCAGCTGCCAACTTTCTCTTTCACATCTTATGAAAGTCATTTAAGCACAAC<br>TAACTTTTTTTTTTTTTTTTTTTTGAGACAGAGTCTTGCTCTGTTGCCCAG<br>GACAGAGTGCAGTAGTGACTCAATCTCGGCTCACTGCAGCCTCCACCTCCTA |

TABLE 24-continued

Examples of regulatory elements (RE) disclosed herein

| Type of RE | Sequence |
|---|---|
| | GGCTCAAACGGTCCTCCTGCATCAGCCTCCCAAGTAGCTGGAATTACAGGA GTGGCCCACCATGCCCAGCTAATTTTTGTATTTTTAATAGATACGGGGGTTT CACCATATCACCCAGGCTGGTCTCGAACTCCTGGCCTCAAGTGATCCACCTG CCTCGGCCTCCCAAAGTGCTGGGATTATAGGCGTCAGCCACTATGCCCAACC CGACCAACCTTTTTTAAAATAAATATTTAAAAAATTGGTATTTCACATATAT ACTAGT |
| SEQ ID NO: 417 | GCCCTCTAGGCCACCTGACCAGGTCCCCTCAGTCCCCCCCTTCCCACACTCC CACACTCAGCCCCCCTCCCCCCCCCCGACCCCTGCAGGATTATCCTGTCTG TGTTCCTGACTCAGCCTGGGAGCCACCTGGGCAGCAGGGGCCAAGGGTGTC CTAGAAGGGACCTGGAGTCCACGCTGGGCCAAGCCTGCCCTTTCTCCCTCTG TCTTCCGTCCCTGCTTGCGGTTCTGCTGAATGTGGTTATTTCTCTGGCTCCTTT TACAGAGAATGCTGCTGCTAATTTTATGTGGAGCTCTGAGGCAGTGTAATTG GAAGCCAGACACCCTGTCAGCAGTGGGCTCCCGTCCTGAGCTGCCATGCTTC CTGCTCTCCTCCCGTCCCGGCTCCTCATTTCATGCAGCCACCTGTCCCAGGGA GAGAGGAGTCACCCAGGCCCCTCAGTCCGCCCCTTAAATAAGAAAGCCTCC GTTGCTCGGCACACATACCAAGCAGCCGCTGGTGCAATCT |

TABLE 25

Additional sequences disclosed herein

| | Sequences |
|---|---|
| SEQ ID NO: 112 (dSaCas9 sequence for modulating GRN) | KRNYILGLAIGITSVGYGIIDYETRDVEDAGVRLFKEANVENNEGRRSKRGARRLKRRRRHRIQRVK KLLFDYNLLTDHSELSGINPYEARVKGLSQKLSEEEFSAALLHLAKRRGVHNVNEVEEDTGNELST KEQISRNSKALEEKVAELQLERLKKDGEVRGSINREKTSDVKEAKQLLKVQKAYHQLDQSFEDT YIDLLETRRTYYEGPGEGSPFGWKDIKEWYEMLMGHCTYFPEELRSVKYAYNADLYNALNDLNN LVITRDENEKLEYYEKFQIIENVEKQKKKPTLKQIAKEILVNEEDEKGYRVTSTGKPEFTNLKVYHDI KDITARKEIIENAELLDQIAKLTIYQSSEDIQEELTNLNSELTQEEIEQISNLKGYTGTHNLSLKAINLI LDELWHTNDNQIAIENRLKLVPKKVDLSQQKEIPTTLVDDFILSPVVKRSFIQSEKVINAIIKKYGLPN DIIIELAREKNSKDAQKMINEMQKRNPQTNERIEEIIRTTGKENAKYLIEKEKLHDMQEGKCLYSLEA IPLEDLLNNPFNYEVDHIIPRSVSEDNSENNKVLVKQEEASKKGNRTPFQYLSSSDSKISYETFKKHIL NLAKGKGRISKTKKEYLLEERDINRFSVQKDFINRNLVDTRYATRGLMNLLRSYFRVNNLLDVKVKS INGGFTSFLRRKMKFKERNKGYKHHAEDALHANADFIFKEWKKLDKAKKVMENQMPEEKQAES MPEIETEQEYKEIFITPHQEKEIITQHKEIIKDEKDYKYSHRVDKKPNRELINDTLYSTRKDDKGNTLIVNNLNGL YDKDNDKLKKLINKSPEKLLMYHHDPQTYQKLKLIMEQYGDEKNPLYKYYEETGNYLITKYSKKD NGPVIKKEKYYGNKLNAHLDITDDYPNSRNKVKLSLKPYREDVYLDNGVYKEVTVKNLDVIKKE NYYEVNSKCYEEAKKLKKISNQAEFIASFYNNDLIKINGELYRVIGVNNDLLNRIEVNMIDITYREY LENMNDKRPPRIEKTIASKTQSIKKYSTDILGNLYEVKSKKHPQIIKKG |
| SEQ ID NO: 186 EF1a promoter | GAGTAATTCATACAAAAGGACTCGCCCCTGCCTTGGGAATCCAGGGACCGTCGTTAAACTC CCACTAACGTAGAACCCAGAGATCGCTGCGTTCCCGCCCCCTCACCCGCCGCTCTCGTCATCA CTGAGGTGGAGAAGAGCATGCGTGAGGCTCCGGTGCCCGTCAGTGGGCAGAGCGCACATCGC CCACAGTCCCCGAGAAGTTGGGGGGAGGGGTCGGCAATTGAACCGGTGCCTAGAGAAGGTG CGCGGGGTAAACTGGGAAAGTGATGTCGTGTACTGGCTCCGCCTTTTTCCCGAGGGTGGGGGA GAACCGTATATAAGTGCAGTAGTCGCCGTGAACGTTCTTTTTCGCAACGGGTTTGCCGCCAGAA CACAGTGAAGTGCCGTGTGTGTTCCCGCGGGCTCGGTGCAGTACGTTAAGGAGCCAGTCCGT GCCTTGAATTACTTCCACGCCCCTGCCTTGAGGCTTGGCTGCCCCCTCGCCTCGTGTCTTGCT AAGTGGGTGGGAGAGTTGAGGCCTGGGCCGCCGCGCGAATCTGGTGGCACCTTCGCTGTCTCGCT GGCCTGGCTGGGCCTCCTAGCCATTTAAAAATTTTGATGACCTGCTGCGACGCTTTTTTTCTGGCA AGATAGTCTTGTAAATGCGGGCCAAGATCTGCACACTGGTATTCTGAGCGCGGGGCCTCGCCC GGCGACCGGGCCCGTGCGTCCAAGCTGCCCGTCGCTGCGGGGCGAGGCGGCC ACCGAGAATCCGACGGGGTAGTCTCAAGCTGGCCGCTTGTGTGTGGCCTCGCCC GCCGTGATCGCCCCGGCTTCCCGCGTCCTGCTGGCCGGAGCTCAAAATGGAGGACGCGGCTCGGGAG AAGATGGCCGCTTGAGTCACCCACACAAAGGAAAAGGCCTTTCCGTCCGACGCCTGCCTTCAT GTGACTCCACGGAGTACCGGGGCTCCAGGACCTCGATTAGTTCGAGCTTTTGGAGTAC GTCGTCTTTAGGTTGGGGGAGGGTTTTATCGATGAGTTCCCACACTGAGTGGGTGGA GACTGAAGTTAGGCCAGCTTGGCACTTGACTTGGTCACACGATGTAATTCCTTGGAATTGCCCTTTTGAGTTG GATCTTGGTTCATTCTCAAGCCTCAGACAGTTCAGCGTCTCCGCGTCTCAGGTGTCG TGA |
| SEQ ID NO: 187 | GAGTTTACTCCCTATCAGTGATAGAGAACGTATGTCGAGTTTACTCCCTATCAGTGATAGAGAA TAGAGAACGTATGTCGAGTTTACTCCCTATCAGTGATAGAGAACGTATGTCGAGTTTACTCCCTATCAGTGA TAGAGAACGTATGTCGAGTTTACTCCCTATCAGTGATAGAGAACGTATGTCGAGTTTATCCCTA TCAGTGATAGAGAACGTATGTCGAGTTTACTCCCTATCAGTGATAGAGAACGTATGTCGAGT AGGCGTGTACGGTGGGAGGCCTATATAAGCAGAGCTCGTTTAGTGAACCGTCAGATCGCCGAA TTCGCCACCATGGTGAGCAAGGGCGAGGAGCTGTTCACCGGGGTGGTGCCCATCCTGGTCGAG CTGGACGGCGACGTAAACGGCCACAAGTTCAGCGTGTCCGGCGAGGGCGAGGGCGATGCCAC |

TABLE 25-continued

Additional sequences disclosed herein

| | Sequences |
|---|---|
| SEQ ID NO: 188 | CTACGGCAAGCTGACCCTGAAGTTCATCTGCACCACCGGCAAGCTGCCCGTGCCCTGGCCCAC<br>CCTCGTGACCACCCTGACCTACGGCGTGCAGTGCTTCAGCCGCTACCCCGACCACATGAAGCA<br>GCACGACTTCTTCAAGTCCGCCATGCCCGAAGGCTACGTCCAGGAGCGCACCATCTTCTTCAAG<br>GACGACGGCAACTACAAGACCCGCGCCGAGGTGAAGTTCGAGGGCGACACCCTGGTGAACCG<br>CATCGAGCTGAAGGGCATCGACTTCAAGGAGGACGGCAACATCCTGGGGCACAAGCTGGAGT<br>ACAACTACAACAGCCACAACGTCTATATCATGGCCGACAAGCAGAAGAACGGCATCAAGGTG<br>AACTTCAAGATCCGCCACAACATCGAGGACGGCAGCGTGCAGCTCGCCGACCACTACCAGCAG<br>AACACCCCCATCGGCGACGGCCCCGTGCTGCTGCCCGACAACCACTACCTGAGCACCCAGTCC<br>GCCCTGAGCAAAGACCCCAACGAGAAGCGCGATCACATGGTCCTGCTGGAGTTCGTGACCGCC<br>GCCGGGATCACTCTCGGCATGGACGAGCTGTACAAGTCCGGACTCAGATCTCGAGAGGAGGAG<br>GAGGAGACAGAGCAGGATGCCGACCTCGGACGCTCCCAGCCGAGACGCTC<br>CTTCCTCTCAAGGGTGATCACCTGCCTCTGAAGATGACTACAGCTGCACCAGGCCAACAACTTTGCCC<br>CTGGCCTGCCTGCTACCCCATGCTGCGGTCCCCATCTCTGCCTCTGAAGATGACTACAGCTGCACCAGGCCAACAACTTTGCCC<br>GATCCTTCTACCCCATGCTGCGGTACCAACGGCCACCTCCCACCCTAGTaataaagatcttt<br>atttcattagatctgtgtgttttttgtgtg |
| SEQ ID NO: 418 | GAGTTTACTCCTATCAGTGATAGAGAACGTATGTCGAGTTTACTCCTATCAGTGATAGAGAA<br>CGATGTCGAGTTTACTCCTATCAGTGATAGAGAACGTATGTCGAGTTTACTCCTATCAGTGA<br>TAGAGAACGTATGTCGAGTTTACTCCTATCAGTGATAGAGAACGTATGTCGAGTTTATCCCTA<br>TCAGTGATGATAGAGAACGTATGTCGAGTTTACTCCTATCAGTGATAGAACGTATGTCGAGT<br>AGGCGTGTACGGTGGGAGGCCTATATAAGCAGAGCTCGTTTAGTGAACCGTCAGATCGCC<br>GCCACCATGGTGAGCAAGGGCGAGGAGCTGTTCACCGGGGTGGTGCCCATCCTGGTCGAGCTG<br>GACGGCGACGTAAACGGCCACAAGTTCAGCGTGTCCGGCGAGGGCGATGCCACCTA<br>CGGCAAGCTGACCCTGAAGTTCATCTGCACCACCGGCAAGCTGCCCGTGCCCTGGCCCACCCT<br>CGTGACCACCCTGACCTACGGCGTGCAGTGCTTCAGCCGCTACCCCGACCACATGAAGCAGCA<br>CGACTTCTTCAAGTCCGCCATGCCCGAAGGCTACGTCCAGGAGCGCACCATCTTCTTCAAGGAC<br>GACGGCAACTACAAGACCCGCGCCGAGGTGAAGTTCGAGGGCGACACCCTGGTGAACCGCAT<br>CGAGCTGAAGGGCATCGACTTCAAGGAGGACGGCAACATCCTGGGGCACAAGCTGGAGTACA<br>ACTACAACAGCCACAACGTCTATATCATGGCCGACAAGCAGAAGAACGGCATCAAGGTGAAC<br>TTCAAGATCCGCCACAACATCGAGGACGGCAGCGTGCAGCTCGCCGACCACTACCAGCAGAAC<br>ACCCCCATCGGCGACGGCCCCGTGCTGCTGCCCGACAACCACTACCTGAGCACCCAGTCCGCC<br>CTGAGCAAAGACCCCAACGAGAAGCGCGATCACATGGTCCTGCTGGAGTTCGTGACCGCCGCC<br>GGGATCACTCTCGGCATGGACGAGCTGTACAAGTCCGGACTCAGATCTCGAGAGGAGGAGGA<br>GGAGACAGAGCAGGATGCCGACCTCGGAGCAGCCCACCTCGGAGCAGCCCACCTGCGGACGCTCCTT<br>CCTCTCAAGGGTGATCAGCCGCTCTACCGTGCAGCTGCTTCTGCTGTCTGCTGCTCCTG<br>GCCTGCCTGCTACCCCATGCTGCGGTACACCAACGGCCACCTCCCACCTAG<br>CCTTCTACCCCATGCTGCGGTACACCAACGGCCACCTCCCACCTAG |
| SEQ ID NO: 365 | MAPKKKRKVGIHGVPAALEPGEKPYKCPECGKSFSRSDNLVRHQRTHTGEKPYKCPECGKSFSHRT<br>TLTNHQRTHTGEKPYKCPECGKSFSQSSLVRHQRTHTGEKPYKCPECGKSFSTSHSLTEHQRTHT<br>GEKPYKCPECGKSFSQSSLVRHQRTHTGEKPYKCPECGKSFSREDNLHTHQRTHTGKKTSKRPAA<br>TKKAGQAKKKKGSYPYDVPDYALEDALDDFDLDMLGSDALDDFDLDMLGS<br>DALDDFDLDML |
| SEQ ID NO: 366 | MAPKKKRKVGIHGVPAALEPGEKPYKCPECGKSFSRSDNLVRHQRTHTGEKPYKCPECGKSFSHRT<br>TLTNHQRTHTGEKPYKCPECGKSFSREDNLHTHQRTHTGEKPYKCPECGKSFSTSHSLTEHQRTHT<br>GEKPYKCPECGKSFSQSSLVRHQRTHTGEKPYKCPECGKSFSREDNLHTHQRTHTGKKITSKRPAA<br>TKKAGQAKKKKGSYPYDVPDYALEEASGSGRADALDDFDLDMLGSDALDD |

TABLE 25-continued

Additional sequences disclosed herein

| Sequences | |
|---|---|
| | FDLDMLGSDALDDFDLDMLINSRSSGSPKKKRKVGSQYLPDTDDRHRIEEKRKRITYETFKSEVIKKS PFSGPTDPRPPRRIAVPSRSASVPKPAPQYPFTSSLSTINYDEPTMFPSQCISQASALAPAPPQV LPQAPAPAPAMVSALAQAPAPVPVLAPGPPQAVAPPAPKPTQAGEGTLSEALLQFDDEDLGA LLGNSTDPAVFTDLASVDNSRFQQLLNQGIPVAPHTTEPMLMEYPRAITRLVTGAQRPPDPAPAPLG APGLPNGLLSGDEDFSSIADMDFSALLGSGSGSRDSREGMFLPKPEAGSAISDVFEGREVCQPKRIRP FHPPGSPWANRPLPASLAPTPTGPVHEPVGSLTPAPVPQPLDPAPAVTPEASHLLEDPDETSQAVK ALREMADTVIPQKEEAICGQMDLSHPPRGHLDELTTTLESMTEDLNLDSPLTPELNEILDTFLND ECLLHAMHISTGLSIFDTSLF |
| SEQ ID NO: 367 control vector EGFP-KASH | GCGGCCGCCACGCGTGGCGCCGCGCCGTTTAAACTTAATTAAGCTAGCCGTTACATAACTTACGGTA ATGGCCCGCCTGGCTGACGACGCCCCGCCATTGACGTCAATAATGACGTATGTT CCCATAGTAACGCCAATAGGGACTTTCCATTGACGTCAATGGGTGGAGTATTTACGGTAAACT GCCCACTTGGCAGTACATCAAGTGTATCATATGCCAAGTACGCCCCCTATTGACGTCAATGACG GTAAATGGCCCGCCTGGCATTATGCCCAGTACATGACCTTATGGGACTTTCCTACTTGGCAGTA CATCTACGTATTAGTCATCGCTATTACCATGGtgatgcggttttggcagtacatcaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctggtttagtgaaccgtcagatccgctagcgctaccggactcagatctcgagctcaagcttcgaattctgcagtcgacggtaccgcgggcccgggatccaccggtcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtccggactcagatctcgagagacgtccgcgggagagcagacagcaggatgcccccggcagctgcttctgtctgctgctcctgggggctgcttccttggagaaggggccgcaccgttgctgctgctctggtgcaccggagactggaggatggctccagccggaggaggaggaggaggagagactcctgcagctgcccgaggaggaggaggagtcgctgtaccgggaggctgcaccgctgaatcctgagaaggtggtggaaccggccgccacctccaggactgttgcaggtgctgttcttcggagccaacactctccatgcacaggccaccacgcgtaacacagctgcccctgggcaccaccagcgctgagtttccaatcaccatggcgagactgcttccagtgcatcctggcaggctccgcaacccggcaccctgcgatggtccgcaggttcagagttttgttcgcgcaacctcctggctgcattgagcaatgacagacgatggaagttcctcctttgctcagcaggagagtaaccctgccagacctgctgagtctgcagcatccactggaactcggtgggagggcctcagcagggggcgctcctcctgaccgggcaagggaccaagggaggcatcatcattccaacccaccggacgctgggactccggcggggatgatccactctcgccgccaagcgcagcaggctcagctgtgcgcagcctgcagggccaggaggctgtgccaagcaggcagcaggtgggacagggcccgctctccggccgccttcccgcagccgctgccaaccgccagccacagccaggaccccgtacccagacaccccagcaccaggggctcgaagggggccccgcgcgtcccggacctccaactgcccgtgctcctgcacctggctgttgtgggaaactcttccatggagcagtgcctgtggacttgccgcagagtctgcagacctccagcgccatgagcctacctggtcaggactcaacctctgcctgcgccgctctcagcactccgccatcctcctctctgcactcgctctcagagcacccgggatccagggggcactcttctttggactgcatactgcgtcaccaatctttgtgctcctagctcgccaccgtatctaggcgggcggacgtgagagagcagaagggcggtctccggaccccagagaatgagaggggggcaccacagccggaatccaaacgagtcctgatcagcctccagggatgcgccggccagccgctgatccccaggcccaccaccactcttaccgggccctcagccgcagccccgccgctctccaatatgcccggaaagtcacgcccagcagcccctgcagtctcgatcgtcgagaggagagagaagagctgcatttgcggcgagccccacagctctcaagggcagcttctgcacctgctcttccacagcgcaccagcctgcccgaaagagagctccccagccgaccatcatccgctgccttcctgggtggaactcatccgggagtctgcctcctgggcctcgtcctttctggtgctgaccgtgagccgctgtgtaactggatcccggccccctgctcatcctgatctctgggctctccaggagaccgcagcccaggtgcagcttgggctacaatgcccgggcgccgccccgtgccttctgggaatgactaggtcacgagcccaacctcgcttcttcttccatggacgtgaactcctgccccacctcggccccagccagtctctaaagcccactctgggcagttcccacctctctcctcagtacacagaggaggtctctaccgggggcagccagctatgccagagttcagagcacagatccgaaggcaatcactcacgagagagcacagcggagccggggccaggaggcccaagatcgccctgctcgccctctttcgtgtgccgcgacgccgatcgagcctcctcaactggcccgagcctctcctcatatctgaagacaggaacggcccgggcccagctcctggccgccgcgccagcgggctcaccgatggtcctggcgcacccctccttgccttggatcgcccttggtaggcgcccgggcccttgctccctctccaggaggccgctggtctcctacacttcctgaatcagaaggcacctaccagtggaactcctgagaatctggcgagccagctcctggacggctggcgatggcccctgaaccctcaggcagccgggtgggacatgagcagctccgaacacgggagctctgggaatagagtgtttgtccctgccatgccccatccgcaacatgcaccaaagcaaccggaggcttctaagcgctcgcgtaccgaggagccagcagcagtccaccagcccgctgctaggcgcgtaactcgctggcagcgatgccgagccttcatcctccggtggtgcagcctccgtccctccctcccagcccctcctcccctccccggcgggggcggcggccctcctcctttggcagaactgtgggcgggcgcccctgacagtcggtgccccaccctgccgctaccgtatctccgtgtcgccaccctccagcgagtagcgttcgcgcgggtctgcttttggaggtgcccgcggagccccagcccccgcgggcccggctccctctgcctgtgcttccaccggaccgtgcctgcagccccctcctttgtgctcctcccagcaacccggggatgacaccccagcagctccccaatccactgacctctatgtcatgtaagtccacgtccttactccccgcagctgctggatcagagcgccccaggccctgcatccaacgggcggtgcccgttggacctcgactcctcagtgccgcacgcatcttgctgctgatctgtgtgaccaggagcgctggaccagtccctggcactcccatcagaaccccatcagggtctcccccactaccttacatcaaccaccccaggctcccagagactagcgcgctaatcaacctgattacaaaattgtgaaagattgactggtatcttcttaactaatggatacgctgcttaatgcctttgtatcatgctattgcttcccgtatggctttcattttctcctccttgtataaatcctggttgctgtcctttatgaggagttgtggcccgttgtcaggcaacgtggcgtggtgtgcactgtgtttgctgacgcaacccccattgcccctctccactgttgccttgcctgtgccagtggctcttcctggctctttgccttggctctcaggcctcaacgggactgacaccacatcgccttggatcgcctcagccgcttggtgttgccaccgagtgactgtgcgcgtgctgcgcctgtcctggggactgccgcgtgtggggcctggtgtttaatcctccatcatcatttggcaaaga |

TABLE 25-continued

Additional sequences disclosed herein

| Sequences | |
|---|---|
| | cgccttcgcctcagacgagtcggatctccctttgggccgctcccgcAGATCTACGGGTGGCATCCCTGTGACCCCTCCC<br>CAGTGCCTCTCCTGGCCCTGGAAGTTGCCACTCCAGTGCCCACCAGCCTTGTCCTTAATAAAATT<br>AAGTTGCATCATTTGTCTGACTAGGTGTCCTTCTATAATATATGGGTGAGGGGGTGTA<br>TGGAGCAAGGGCAAGTTGGGAAGACAACCTGTAGGGCCTGCGGGGTCTATTGGAACCAAG<br>CTGGAGTGCAGTGGCACAATCTTGGCTCACTGCAATCTCCGCCTCCTGGGTTCAAGCGATTCTC<br>CTGCCTCAGCCTCCCGAGTTGTTGGGATTCAGGCATGCATGCCAGGCTCAGCTAATTTTTGT<br>TTTTTTGGTAGAGACGGGGTTTCACCATATTGCCAGGCTGGTCTCAACTCCTAATCTCAGGT<br>GATCTACCCACCTTGGCCTCCCAAATTGCTGGGATTACAGGCGTGAACCACTGCTCCCTTCCCT<br>GTCCTTCTGATTTTGTAGGTAACCACGTGCGACCCAGCGGCCGC |
| SEQ ID<br>NO: 368<br>EGFP-<br>KASH<br>driven by<br>CBA<br>promoter | GCGGCCGCACGCGTGGCGCGCCGTTTAAACTTAATTAAGCTAGCCGTTACATAACTTACGGTA<br>AATGGCCCGCCTGGCTGACCGCCCAACGACCCCCGCCCATTGACGTCAATAATGACCTATGTT<br>CCCATAGTAACGCCAATAGGGACTTTCCATTGACGTCAATGGGTGGAGTATTTACGGTAAACT<br>GCCCACTTGGCAGTACATCAAGTGTATCATATGCCAAGTACGCCCCCTATTGACGTCAATGACG<br>GTAAATGGCCCGCCTGGCATTATGCCCAGTACATGACCTTATGGGACTTTCCTACTTGGCAGTA<br>CATCTACGTATTAGTCATCGCTATTACCATGgtcgaggtgagcccacgttctgcttcactctccccatctcccccccctccc<br>accccaattagtattattttaattatttttgtcagcgatgggggcggggggggcgcgcgccaggcggggcgggggcgagggg<br>cggggcggggcgaggcggagaggtgcggcggcagccaatcagagcggcgcgctccgaaagtttccttttatgcggctccccgtctgtgccgcccccgcctctgactg<br>tataaaaagcgaagcgcgcggcgggcgggagtgcgtcgtctgcctgcgcgtcccctattggacgcacccggctctgtgttaactggctcgtggtccggacccggctcggcccgg<br>accgcgtactcccacaggtgagcgggcgggacggcccttctcctccggagttgtggccccttcgcgccaccatccccttcgtggggggctcggagcgtgttcttcctgtagtttctgtgctgcctgactgc<br>agccttaaaaggctccggaggcctccgcggccgcgggctttgtgcgctcctgagcgaagcgggcgtgtgttggggaagcgccgtgtgcccgcc<br>gctgccccggcgctgtgagcgctgaggccggaaacaaaggctgccgctgccggcggccgtgtgcgtgcgcgcggcggcgctggcgctggccttgttcggccggcgaggcggggaccgcggtcaacccc<br>tgcgggggccctcccccgagttgtgaacgacgggccggttgcggtgcgtgcgcggcggctcctgcgcgcggccggg<br>ggtggccggcagtgggtgccggcggcgggccaatgcctttatgtaatcgtgcgagaggccagggactctcctttgtccaaatctggcggagccgaaatctg<br>gctgtcgaggccgcgggcagccgcacccccctcagcgggcgggccgaaaggtgcgcgcggaaggtggtcaccctgaactgtc<br>gaggcgccgccgcaccccctcagcgcggcggcccgaaaggtgcgcgcggaaggtggtgcagcggcaggggcaggggtccgcttcggcctgcgt<br>gcggccgctcctccatccccagccgggggcaggggccgggttcgcggcggcaggggcaggggtccgcttcggcctgcgt<br>gacggcgggctctagagcctctgctaacatgtcatgctcttcttttctacagctcctgggcaacgtgctggttgtgtgctgtcatcatttggcaaaga<br>atGGTACCGCCACCATGGTGAGCAAGGGCGAGGAGCTGTTCACCGGGGTGTGCCATCCTGG<br>TCGAGCTGGACGGCGACGTAAACGGCCACAAGTTCAGCGTGTCCGGCGAGGGCGAT<br>GCCACCTACGGCAAGCTGACCCTGAAGTTCATCTGCACCACCGGCAAGCTGCCCGTGCCCTGG<br>CCCACCCTCGTGACCACCCTGACCTACGGCGTGCAGTGCTTCAGCCGCTACCCCGACCACATGA<br>AGCAGCACGACTTCTTCAAGTCCGCCATGCCCGAAGGCTACGTCCAGGAGCGCACCATCTTCTT<br>CAAGGACGACGGCAACTACAAGACCCGCGCCGAGGTGAAGTTCGAGGGCGACACCCTGGTGA<br>ACCGCATCGAGCTGAAGGGCACATCGACTTCAAGGAGGACGGCAACATCCTGGGGCACAAGCTG<br>GAGTACAACTACAACAGCCACAACGTCTATATCATGGCCGACAAGCAGAAGAACGGCATCAA<br>GGTGAACTTCAAGATCCGCCACAACATCGAGGACGGCAGCGTGCAGCTCGCCGACCACTACCA<br>GCAGAACACCCCCATCGGCGACGGCCCCGTGCTGCCCGACAACCACTACCTGAGCACCCA |

TABLE 25-continued

Additional sequences disclosed herein

| Sequences |
|---|
| GTCCGCCCTGAGCAAAGACCCCAACGAGAAGCGCGATCACATGGTCCTGCTGGAGTTCGTGAC<br>CGCCGCCGGATCACTTCTCGGCCATGACGAGCTGTACAAGTCCGGACTCAGATCTCGAGAGGA<br>GGAGGAGGACAGACAGCAGGATGCCCACCTGACGCCCCGGCAGTCCCAGCCGAGAC<br>GCTCCTTCCTCCAAGGGTGATCAGGGCAGCTCTACCGTTGCAGCTGCTTCTGCTGCTGCT<br>GCTCCTGGCCTGCCTGCTACCTGCCTCTGAAGATGACTACAGCTGCACCAGGCCAACAACTTT<br>GCCCGATCCTTCTACCCCATGCTGCCGTACCACCAACGGGCCACCTCCACCTAGAGCGCTaatcaa<br>cctctgattacaaaaattgtgaaagattgactggtatctctaactatgtgctccttttacgctgatatgtggatacgctgcttaatgctgtcttagtatcatgctattgcttccc<br>gtatgctttcattttctccctctgtataaatcctggtgctgtctcttatgaggagttgtggcccgttgtcaggcaacgtggcgtggtgcactgtgtttgctga<br>cgcaacccccactggtgggcattgccaccaccctgcagctccttccggacttctgcttccccctcctcattgccacggcggaactcatcgccgctgcc<br>ttgcccgctgctggacagggctcggctgttgggcactgacaatcctgtggtgtgtcgggggaaatcatcgtccttttccttggctgtcgctcgctatgttgccacct<br>ggattctgcgggacagtcctctcgctactgtccctccgggcccctcaatccagccgcacctttccttcccggcctgctgccggctctgggcctcttccggtctt<br>cgccttcgcctcagacgagtccgatctccctttgggccgcctccccgcAGATCTACGGGTGGCATTCCCCTGACCCCTCCC<br>CAGTGCCTCCTCCTGGCCCTGGAAGTTGCCACTCCAGTGCCCACCAGCCTTGTCCTAATAAATT<br>AAGTTGCATCATTTTGTCTGACTAGGTGTCCTTCTATAATATTATGGGGGTGGAGGGGGTGGTA<br>TGGAGCAAGGGGCAAGTTGGGAAGACAACCTGTAGGGCCTGCGGGGTCTATTGGGAACCAAG<br>CTGGAGTGCAGTGGCACAATCTTGGCTCACTCCAATCTCCGCCTCCTGGGTTCAAGCGATTCTC<br>CTGCCTCAGCCTCCGAGTTGTTGGGATTCCAGGACATGACCAGGCTCAGCTAATTTTTGT<br>TTTTTGGTAGAGACGGGGTTTCACCATATTGGCCAGGCTGGTCTCCAACTCCTAATCTCAGGT<br>GATCTACCACCTTGGCCTCCCAAATTGCTGGGATTACAGGCGTGAACCACTGCTCCCTTCCCT<br>GTCCTTCTGATTTTGTAGGTAACCACGTGCGACCGAGCGCGC |
| SEQ ID<br>NO: 422<br>WT EGR3 | MTGKLAEKLPVTMSSLLNQLPDNLYPEEIPSALNLFSGSSDSVVHYNQMATENVMDIGLTNEKPNP<br>ELSYSGSFQPAPGNKTVTYLGKFAFDSPSNWCQDNIISLMSAGILGVPPASGALSTQTSTASMVQPP<br>QGDVEAMYPALPPYSNCGDLYSEPVSFHDPQQNPGLAYSPQDYQSAKPALDSNLFPMIPDYNLYH<br>HPNDMGSIPEHKPFQGMDPIRVNPPPITPLETIKAFKDKQIHPGFGSLPQPPLTLKPIRPRKYPNRPSK<br>TPLHERPHACPAEBGCDRRFSRSDELTRHLRIHTGHKPFQCRICMRSFSRSDHLTTHIRTHTGEKPFAC<br>EFCGRKFARSDERKRHAKIHLKQKEKKAEKGGAPSASSAPPVSLAPVVTTCA |

TABLE 26

SCN1A genomic regions targeted by gRNA and dCas protein

| Human Chr 2 Start Position- where target sequence is located | SEQ ID NO of gRNA | Guide RNA Sequence (corresponding to genomic sequence recognized by the gRNA) |
|---|---|---|
| 166178880 | 197 | ggtacgggcaaagatttcttg |
| 166178871 | 198 | tttgcccgtaccaaagtcttg |
| 166177369 | 201 | ACACAATGAGCCACCTACAAG |
| 166177362 | 202 | GTGGCTCATTGTGTGTGTGCC |
| 166177299 | 203 | AGAAAGCTGATACAGATACAA |
| 166155393 | 207 | TTCTCAGTTTTGAAATTAAAA |
| 166155264 | 208 | CATATCCCTGCAGGTTCAGAA |
| 166155255 | 209 | TGGATTCTCTTCTGAACCTGC |
| 166155099 | 210 | agagagagagagagagagaga |
| 166149373 | 211 | TGGTCTCATTCTTTTGTGGG |
| 166149176 | 107 | aaggctgtctaggtcaagtgt |
| 166149118 | 224 | tgttcctccagattaacactt |
| 166148953 | 225 | ATTACAGTTCTGTCAGCATGC |
| 166148843 | 226 | ATCATCTGTAACCATCAAGGA |
| 166148565 | 227 | TCCTGCCTACTTAGTTTCAAG |
| 166148361 | 228 | TGCTGAGGCAGGACACAGTGT |
| 166142396 | 229 | ACAAAGTAAGTGTCAGTGTGG |

TABLE 26-continued

SCN1A genomic regions targeted by gRNA and dCas protein

| Human Chr 2 Start Position- where target sequence is located | SEQ ID NO of gRNA | Guide RNA Sequence (corresponding to genomic sequence recognized by the gRNA) |
|---|---|---|
| 166142391 | 230 | CTGACACTTACTTTGTCTAAA |
| 166142344 | 231 | ATAATAGTTGTGTCTTTATAA |
| 166142239 | 232 | CGATATTTTCATGGATTCCTT |
| 166142219 | 233 | AAAACTGGAACCGCATTCCCA |
| 166141162 | 234 | TGTACAAGCAGGGCTGCAAAG |
| 166141145 | 235 | AAAGGGGAATGGGAACACCCG |
| 166141090 | 236 | ATGTTCAAGGTGCAGAAGGAA |
| 166140928 | 237 | ttcaacaagctcccaagaagt |
| 166140590 | 238 | GTTAACAAATACACTAAACAC |
| 166128037 | 109 | gctgatttgtattaggtacca |
| 166128002 | 108 | gatgaagccgagaggatactg |
| 165990246 | 247 | TGTTTGCTCAAACGTGCACCA |
| 165990193 | 248 | AAATATGTACCACAAGAAATG |
| 165990076 | 249 | TATCTGGTTTCTCTCACTGCT |
| 165989684 | 250 | AAATAAGACATGAAAACAAGA |
| 165989571 | 251 | ATTGCAAAGCATAATTTGGAT |

TABLE 27

Examples of SCN1A genomic regions targeted by zinc finger eTFs

| Human Chr 2 Start Position- where target sequence is located | SEQ ID NO of Target Site | Target site sequence recognized by DNA binding protein | SEQ ID NO of eTF |
|---|---|---|---|
| 166149168 | 35 | ctaggtcaagtgtaggag | 271 |
| 166149165 | 257 | GGTCAAGTGTAGGAGACA | 273 |
| 166128025 | 36 | taggtaccatagagtgag | 279 |
| 166127991 | 136 | gaggatactgcagaggtc | 280 |

TABLE 28

Amino acid sequences eTFs that recognize SCN1A target sites

| eTF SEQ ID NO: | eTF Sequence | Target site recognized |
|---|---|---|
| SEQ ID NO: 272 | MAPKKKRKVGIHGVPAALEPGEKPYKCPECGKSFSSKKALTEHQRTHTGEKPYKCPECG KSFSSPADLTRHQRTHTGEKPYKCPECGKSFSRSDNLVRHQRTHTGEKPYKCPECGKSFS REDNLHTHQRTHTGEKPYKCPECGKSFSRSDELVRHQRTHTGEKPYKCPECGKSFSQSG NLTEHQRTHTGEKPYKCPECGKSFSTSGHLVRHQRTHTGEKPYKCPECGKSFSQNSTLTE HQRTHTGKKTSKRPAATKKAGQAKKKKGSYPYDVPDYALEDALDDFDLDMLGSDALD DFDLDMLGSDALDDFDLDMLGSDALDDFDLDML | SEQ ID NO: 257 |
| SEQ ID NO: 280 | MAPKKKRKVGIHGVPAALEPGEKPYKCPECGKSFSDPGALVRHQRTHTGEKPYKCPECG KSFSRSDNLVRHQRTHTGEKPYKCPECGKSFSQSGDLRRHQRTHTGEKPYKCPECGKSFS THLDLIRHQRTHTGEKPYKCPECGKSFSTSGNLVRHQRTHTGEKPYKCPECGKSFSRSDN LVRHQRTHTGKKTSKRPAATKKAGQAKKKKGSYPYDVPDYALEDALDDFDLDMLGSD ALDDFDLDMLGSDALDDFDLDMLGSDALDDFDLDML | SEQ ID NO: 136 |

TABLE 29

Amino acid sequences of DBDs of eTFs

| eTF SEQ ID NO: | DBD SEQ ID NO: | DBD sequence |
|---|---|---|
| SEQ ID NO: 270 | SEQ ID NO: 393 | LEPGEKPYKCPECGKSFSRKDNLKNHQRTHTGEKPYKCPECGKSFSDPGALVRHQRTH TGEKPYKCPECGKSFSREDNLHTHQRTHTGEKPYKCPECGKSFSDPGALVRHQRTHTGE KPYKCPECGKSFSTSGELVRHQRTHTGEKPYKCPECGKSFSRKDNLKNHQRTHTGKKT S |
| SEQ ID NO: 272 | SEQ ID NO: 395 | LEPGEKPYKCPECGKSFSSKKALTEHQRTHTGEKPYKCPECGKSFSSPADLTRHQRTHT GEKPYKCPECGKSFSRSDNLVRHQRTHTGEKPYKCPECGKSFSREDNLHTHQRTHTGE KPYKCPECGKSFSRSDELVRHQRTHTGEKPYKCPECGKSFSQSGNLTEHQRTHTGEKPY KCPECGKSFSTSGHLVRHQRTHTGEKPYKCPECGKSFSQNSTLTEHQRTHTGKKTS |
| SEQ ID NO: 278 | SEQ ID NO: 401 | LEPGEKPYKCPECGKSFSRNDALTEHQRTHTGEKPYKCPECGKSFSDPGHLVRHQRTHT GEKPYKCPECGKSFSTSGELVRHQRTHTGEKPYKCPECGKSFSTHLDLIRHQRTHTGEK PYKCPECGKSFSSKKALTEHQRTHTGEKPYKCPECGKSFSQLAHLRAHQRTHTGEKPYK CPECGKSFSRSDHLTNHQRTHTGKKTS |
| SEQ ID NO: 280 | SEQ ID NO: 403 | LEPGEKPYKCPECGKSFSDPGALVRHQRTHTGEKPYKCPECGKSFSRSDNLVRHQRTHT GEKPYKCPECGKSFSQSGDLRRHQRTHTGEKPYKCPECGKSFSTHLDLIRHQRTHTGEK PYKCPECGKSFSTSGNLVRHQRTHTGEKPYKCPECGKSFSRSDNLVRHQRTHTGKKTS |
| SEQ ID NO: 281 | SEQ ID NO: 404 | LEPGEKPYKCPECGKSFSQAGHLASHQRTHTGEKPYKCPECGKSFSREDNLHTHQRTHT GEKPYKCPECGKSFSTSGNLTEHQRTHTGEKPYKCPECGKSFSTHLDLIRHQRTHTGEKP YKCPECGKSFSQKSSLIAHQRTHTGEKPYKCPECGKSFSQAGHLASHQRTHTGKKTS |
| SEQ ID NO: 282 | SEQ ID NO: 405 | LEPGEKPYKCPECGKSFSTTGNLTVHQRTHTGEKPYKCPECGKSFSTSGELVRHQRTHT GEKPYKCPECGKSFSREDNLHTHQRTHTGEKPYKCPECGKSFSTSGNLTEHQRTHTGEK PYKCPECGKSFSQSSSLVRHQRTHTGEKPYKCPECGKSFSQRANLRAHQRTHTGKKTS |

TABLE 30

GRN target regions and eTFs for upregulating expression of GRN

| eTF SEQ ID NO: | eTF sequence | Target site SEQ ID NO: |
|---|---|---|
| SEQ ID NO: 337 | MAPKKKRKVGIHGVPAALEPGEKPYKCPECGKSFSTSHSLTEHQRTHTGEKPYKCP ECGKSFSDCRDLARHQRTHTGEKPYKCPECGKSFSTTGNLTVHQRTHTGEKPYKC PECGKSFSDPGALVRHQRTHTGEKPYKCPECGKSFSTHLDLIRHQRTHTGEKPYKC PECGKSFSHTGHLLEHQRTHTGKKTSKRPAATKKAGQAKKKKGSYPYDVPDYAL EDALDDFDLDMLGSDALDDFDLDMLGSDALDDFDLDMLGSDALDDFDLDML | SEQ ID NO: 330 |
| SEQ ID NO: 338 | MAPKKKRKVGRIGVPAALEPGEKPYKCPECGKSFSRNDTLTEHQRTHTGEKPYKC PECGKSFSDPGALVRHQRTHTGEKPYKCPECGKSFSTSGELVRHQRTHTGEKPYKC PECGKSFSRSDNLVRHQRTHTGEKPYKCPECGKSFSTSGELVRHQRTHTGEKPYKC PECGKSFSTKNSLTEHQRTHTGKKTSKRPAATKKAGQAKKKKGSYPYDVPDYALE DALDDFDLDMLGSDALDDFDLDMLGSDALDDFDLDMLGSDALDDFDLDML | SEQ ID NO: 331 |
| SEQ ID NO: 339 | MAPKKKRKVGIHGVPAALEPGEKPYKCPECGKSFSTSGNLTEHQRTHTGEKPYKC PECGKSFSRADNLTEHQRTHTGEKPYKCPECGKSFSSPADLTRHQRTHTGEKPYKC | SEQ ID No: 336 |

TABLE 30-continued

GRN target regions and eTFs for upregulating expression of GRN

| eTF SEQ ID NO: | eTF sequence | Target site SEQ ID NO: |
|---|---|---|
| | PECGKSFSQSSNLVRHQRTHTGEKPYKCPECGKSFSQRANLRAHQRTHTGEKPYK CPECGKSFSQLAHLRAHQRTHTGEKPYKCPECGKSFSHRTTLTNHQRTHTGKKTSK RPAATKKAGQAKKKKGSYPYDVPDYALEEASGSGRADALDDFDLDMLGSDALD DFDLDMLGSDALDDFDLDMLGSDALDDFDLDMLINSRSSGSPKKKRKVGSQYLPD TDDRHRIEEKRKRTYETFKSIMKKSPFSGPTDPRPPPRRIAVPSRSSASVPKPAPQPY PFTSSLSTINYDEFPTMVFPSGQISQASALAPAPPQVLPQAPAPAPAPAMVSALAQA PAPVPVLAPGPPQAVAPPAPKPTQAGEGTLSEALLQLQFDDEDLGALLGNSTDPAV FTDLASVDNSEFQQLLNQGIPVAPHTTEPMLMEYPEAITRLVTGAQRPPDPAPAPLG APGLPNGLLSGDEDFSSIADMDFSALLGSGSGSRDSREGMFLPKPEAGSAISDVFEG REVCQPKRIRPFHPPGSPWANRPLPASLAPTPTGPVHEPVGSLTPAPVPQPLDPAPA VTPEASHLLEDPDEETSQAVKALREMADTVIPQKEEAAICGQMDLSHPPPRGHLDE LTTTLESMTEDLNLDSPLTPELNEILDTFLNDECLLHAMHISTGLSIFDTSLF | |
| SEQ ID NO: 340 | MAPKKKRKVGIHGVPAALEPGEKPYKCPECGKSFSSPADLTRHQRTHTGEKPYKC PECGKSFSDSGNLRVHQRTHTGEKPYKCPECGKSFSQLAHLRAHQRTHTGEKPYK CPECGKSFSQRANLRAHQRTHTGEKPYKCPECGKSFSREDNLHTHQRTHTGEKPY KCPECGKSFSRSDNLVRHQRTHTGKKTSKRPAATKKAGQAKKKKGSYPYDVPDY ALEDALDDFDLDMLGSDALDDFDLDMLGSDALDDFDLDMLGSDALDDFDLDML | SEQ ID NO: 38 |
| SEQ ID NO: 341 | MAPKKKRKVGIHGVPAALEPGEKPYKCPECGKSFSSPADLTRHQRTHTGEKPYKC PECGKSFSDSGNLRVHQRTHTGEKPYKCPECGKSFSQLAHLRAHQRTHTGEKPYK CPECGKSFSQRANLRAHQRTHTGEKPYKCPECGKSFSREDNLHTHQRTHTGEKPY KCPECGKSFSRSDNLVRHQRTHTGKKTSKRPAATKKAGQAKKKKGSYPYDVPDY ALEEASGSGRADALDDFDLDMLGSDALDDFDLDMLGSDALDDFDLDMLGSDALD DFDLDMLINSRSSGSPKKKRKVGSQYLPDTDDRHRIEEKRKRTYETFKSIMKKSPFS GPTDPRPPPRRIAVPSRSSASVPKPAPQPYPFTSSLSTINYDEFPTMVFPSGQISQASA LAPAPPQVLPQAPAPAPAPAMVSALAQAPAPVPVLAPGPPQAVAPPAPKPTQAGEG TLSEALLQLQFDDEDLGALLGNSTDPAVFTDLASVDNSEFQQLLNQGIPVAPHTTE PMLMEYPEAITRLVTGAQRPPDPAPAPLGAPGLPNGLLSGDEDFSSIADMDFSALL GSGSGSRDSREGMFLPKPEAGSAISDVFEGREVCQPKRIRPFHPPGSPWANRPLPAS LAPTPTGPVHEPVGSLTPAPVPQPLDPAPAVTPEASHLLEDPDEETSQAVKALREM ADTVIPQKEEAAICGQMDLSHPPPRGHLDELTTTLESMTEDLNLDSPLTPELNEILD TFLNDECLLHAMHISTGLSIFDTSLF | SEQ ID NO: 38 |
| SEQ ID NO: 342 | MAPKKKRKVGIHGVPAALEPGEKPYKCPECGKSFSSPADLTRHQRTHTGEKPYKC PECGKSFSDSGNLRVHQRTHTGEKPYKCPECGKSFSQLAHLRAHQRTHTGEKPYK CPECGKSFSQRANLRAHQRTHTGEKPYKCPECGKSFSREDNLHTHQRTHTGEKPY KCPECGKSFSRSDNLVRHQRTHTGKKTSKRPAATKKAGQAKKKKGSYPYDVPDY ALEEASGSGRADALDDFDLDMLGSDALDDFDLDMLGSDALDDFDLDMLGSDALD DFDLDMLINSRSSGSPKKKRKVGSQYLPDTDDRHRIEEKRKRTYETFKSIMKKSPFS GPTDPRPPPRRIAVPSRSSASVPKPAPQPYPFTSSLSTINYDEFPTMVFPSGQISQASA LAPAPPQVLPQAPAPAPAPAMVSALAQAPAPVPVLAPGPPQAVAPPAPKPTQAGEG TLSEALLQLQFDDEDLGALLGNSTDPAVFTDLASVDNSEFQQLLNQGIPVAPHTTE PMLMEYPEAITRLVTGAQRPPDPAPAPLGAPGLPNGLLSGDEDFSSIADMDFSALL GSGSGSRDSREGMFLPKPEAGSAISDVFEGREVCQPKRIRPFHPPGSPWANRPLPAS LAPTPTGPVHEPVGSLTPAPVPQPLDPAPAVTPEASHLLEDPDEETSQAVKALREM ADTVIPQKEEAAICGQMDLSHPPPRGHLDELTTTLESMTEDLNLDSPLTPELNEILD TFLNDECLLHAMHISTGLSIFDTSLF | SEQ ID NO: 38 |
| SEQ ID NO: 343 | MAPKKKRKVGIHGVPAALEPGEKPYKCPECGKSFSSPADLTRHQRTHTGEKPYKC PECGKSFSDSGNLRVHQRTHTGEKPYKCPECGKSFSQLAHLRAHQRTHTGEKPYK CPECGKSFSQRANLRAHQRTHTGEKPYKCPECGKSFSREDNLHTHQRTHTGEKPY KCPECGKSFSRSDNLVRHQRTHTGKKTSKRPAATKKAGQAKKKKGSYPYDVPDY ALEDALDDFDLDMLGSDALDDFDLDMLGSDALDDFDLDMLGSDALDDFDLDML | SEQ ID NO: 38 |
| SEQ ID NO: 344 | MAPKKKRKVGIHGVPAALEPGEKPYKCPECGKSFSTSHSLTEHQRTHTGEKPYKCP ECGKSFSHKNALQNHQRTHTGEKPYKCPECGKSFSERSHLREHQRTHTGEKPYKC PECGKSFSSKKALTEHQRTHTGEKPYKCPECGKSFSQRANLRAHQRTHTGEKPYK CPECGKSFSRKDNLKNHQRTHTGEKPYKCPECGKSFSQSSNLVRHQRTHTGEKPY KCPECGKSFSQSSSLVRHQRTHTGEKPYKCPECGKSFSQAGHLASHQRTHTGKKTS KRPAATKKAGQAKKKKGSYPYDVPDYALEEASGSGRADALDDFDLDMLGSDAL DDFDLDMLGSDALDDFDLDMLGSDALDDFDLDMLINSRSSGSPKKKRKVGSQYLP DTDDRHRIEEKRKRTYETFKSIMKKSPFSGPTDPRPPPRRIAVPSRSSASVPKPAPQP YPFTSSLSTINYDEFPTMVFPSGQISQASALAPAPPQVLPQAPAPAPAPAMVSALAQ APAPVPVLAPGPPQAVAPPAPKPTQAGEGTLSEALLQLQFDDEDLGALLGNSTDPA VFTDLASVDNSEFQQLLNQGIPVAPHTTEPMLMEYPEAITRLVTGAQRPPDPAPAPL GAPGLPNGLLSGDEDFSSIADMDFSALLGSGSGSRDSREGMFLPKPEAGSAISDVFE GREVCQPKRIRPFHPPGSPWANRPLPASLAPTPTGPVHEPVGSLTPAPVPQPLDPAP AVTPEASHLLEDPDEETSQAVKALREMADTVIPQKEEAAICGQMDLSHPPPRGHLD ELTTTLESMTEDLNLDSPLTPELNEILDTFLNDECLLHAMHISTGLSIFDTSLF | SEQ ID NO: 335 |
| SEQ ID NO: 345 | MQSQLIKPSRMRKYPNRPSKTPPHERPYACPVESCDRRFSSPADLTRHIRIHTGQKP FQCRICMRNFSDSGNLRVHIRTHTGEKPFACDICGRKFAQLAHLRAHTKIHLRQKD RPYACPVESCDRRFSQRANLRAHIRIHTGQKPFQCRICMRNFSREDNLHTHIRTHTG EKPFACDICGRKFARSDNLVRHTKIHLRQKDKLEMSGLEMADHMMAMNHGRFPD | SEQ ID NO: 38 |

TABLE 30-continued

GRN target regions and eTFs for upregulating expression of GRN

| eTF SEQ ID NO: | eTF sequence | Target site SEQ ID NO: |
|---|---|---|
| | GTNGLHHHPAHRMGMGQFPSPHHHQQQQPQHAFNALMGEHIHYGAGNMNATSG IRHAMGPGTVNGGHPPSALAPAARFNNSQFMGPPVASQGGSLPASMQLQKLNNQ YFNHHPYPHNHYMPDLHPAAGHQMNGTNQHFRDCNPKHSGGSSTPGGSGGSSTP GGSGSSSGGGAGSSNSGGGSGSGNMPASVAHVPAAMLPPNVEDTDFIDEEVLMSL VIEMGLDRIKELPELWLGQNEFDFMTDFVCKQQPSRVSC | |
| SEQ ID NO: 60 | MSGLEMADHMMAMNHGRFPDGTNGLHHHPAHRMGMGQFPSPHHHQQQQPQHA FNALMGEHIHYGAGNMNATSGVRHAMGPGTVNGGHPPSALAPAARFNNSQFMGP PVASQGGSLPASMQLQKLNNQYFNHHPYPHNHYMPDLHPAAGHQMNGTNQHFR DCNPKHSGGSSTPGGSGGSSTPGGSGSSSGGGAGSSNSGGGSGSGNMPASVAHVP AAMLPPNVIDTDFIDEEVLMSLVIEMGLDRIKELPELWLGQNEFDFMTDFVCKQQP SRVSCQSQLEKPSRMRKYPNRPSKTPPHERPYACPVESCDRRFSRRDELNVHIRIHT GQKPFQCRICMRNFSSRRTCRAHIRTHTGEKPFACDICGRKFAQSSNLVRHTKIHLR QKDRPYACPVESCDRRFSQLAHLRAHIRIHTGQKPFQCRICMRNFSTSGNLVRHIRT HTGEKPFACDICGRKFAHRTTLTNHTKIHLRQKDK | SEQ ID NO: 38 |
| SEQ ID NO: 346 | MSGLEMADHMMAMNHGRFPDGTNGLHHHPAHRMGMGQFPSPHHHQQQQPQHA FNALMGEHIHYGAGNMNATSGVRHAMGPGTVNGGHPPSALAPAARFNNSQFMGP PVASQGGSLPASMQLQKLNNQYFNHHPYPHNHYMPDLHPAAGHQMNGTNQHFR DCNPKHSGGSSTPGGSGGSSTPGGSGSSSGGGAGSSNSGGGSGSGNMPASVAHVP AAMLPPNVIDTDFIDEEVLMSLVIEMGLDRIKELPELWLGQNEFDFMTDFVCKQQP SRVSCQSQLEKPSRMRKYPNRPSKTPPHERPYACPVESCDRRFSSPADLTRHIRIHTG QKPFQCRICMRNFSDSGNLRVHIRTHTGEKPFACDICGRKFAQLAHLRAHTKIHLR QKDRPYACPVESCDRRFSQRANLRAHIRIHTGQKPFQCRICMRNFSREDNLHTHIRT HTGEKPFACDICGRKFARSDNLVRHTKIHLRQKDK | SEQ ID NO: 38 |
| SEQ ID NO: 63 | MQSQLIKPSRMRKYPNRPSKTPPHERPYACPVESCDRRFSSPADLTRHIRIHTGQKP FQCRICMRNFSDSGNLRVHIRTHTGEKPFACDICGRKFAQLAHLRAHTKIHLRQKD RPYACPVESCDRRFSQRANLRAHIRIHTGQKPFQCRICMRNFSREDNLHTHIRTHTG EKPFACDICGRKFARSDNLVRHTKIHLRQKDKLEMADHLMLAEGYRLVQRPPSAA AAHGPHALRTLPPYAGPGLDSGLRPRGAPLGPPPPRQPGALAYGAFGPPSSFQPFPA VPPPAAGIAHLQPVATPYPGRAAAPPNAPGGPPGPQPAPSAAAPPPPAHALGGMDA ELIDEEALTSLELELGLHRVRELPELFLGQSEFDCFSDLGSAPPAGSVSC | SEQ ID NO: 38 |
| SEQ ID NO: 64 | MAADHLMLAEGYRLVQRPPSAAAAHGPHALRTLPPYAGPGLDSGLRPRGAPGPP PPRQPGALAYGAFGPPSSFQPFPAVPPPAAGIAHLQPVATPYPGRAAAPPNAPGGPP GPQPAPSAAAPPPPAHALGGMDAELIDEEALTSLELELGLHRVRELPELFLGQSEFD CFSDLGSAPPAGSVSCGGSGGGSGQSQLIKPSRMRKYPNRPSKTPPHERPYACPVES CDRRFSSPADLTRHIRIETGQKPFQCRICMRNFSDSGNLRVHIRTHTGEKPFACDICG RKFAQLAHLRAHTKIHLRQKDRPYACPVESCDRRFSQRANLRAHIRIHTGQKPFQC RICMRNFSREDNLHTHIRTHTGEKPFACDICGRKFARSDNLVRHTKIHLRQKDKLE MADHLMLAEGYRLVQRPPSAAAAHGPHALRTLPPYAGPGLDSGLRPRGAPLGPPP PRQPGALAYGAFGPPSSFQPFPAVPPPAAGIAHLQPVATPYPGRAAAPPNAPGGPPG PQPAPSAAAPPPPAHALGGMDAELIDEEALTSLELELGLITRVRELPELFLGQSEFDC FSDLGSAPPAGSVSC | SEQ ID NO: 38 |
| SEQ ID NO: 347 | MRPHACPAEGCDRRFSSPADLTRHLRIHTGHKPFQCRICMRSFSDSGNLRVHIRTHT GEKPFACEFCGRKFAQLAHLRAHAKIHLKQKEHACPAEGCDRRFSQRANLRAHLR NTGHKPFQCRICMRSFSREDNLHTHIRTHTGEKPFACEFCGRKFARSDNLVRHAKI HLKQKEKKAEKGGAPSASSAPPVSLAPVVTTCALEMSGLEMADHMMAMNHGRFP DGTNGLHHHPAHRMGMGQFPSPHHHQQQQPQHAFNALMGEHIHYGAGNMNATS GIRHAMGPGTVNGGHPPSALAPAARFNNSQFMGPPVASQGGSLPASMQLQKLNN QYFNHHPYPHNHYMPDLHPAAGHQMNGTNQHFRDCNPKHSGGSSTPGGSGGSST PGGSGSSSGGGAGSSNSGGGSGSGNMPASVAHVPAAMLPPNVEDTDFIDEEVLMSL VIEMGLDRIKELPELWLGQNEFDFMTDFVCKQQPSRVSC | SEQ ID NO: 38 |
| SEQ ID NO: 348 | MSGLEMADHMMAMNHGRFPDGTNGLHHHPAHRMGMGQFPSPHHHQQQQPQHA FNALMGEHIHYGAGNMNATSGVRHAMGPGTVNGGHPPSALAPAARFNNSQFMGP PVASQGGSLPASMQLQKLNNQYFNHHPYPHNHYMPDLHPAAGHQMNGTNQHFR DCNPKHSGGSSTPGGSGGSSTPGGSGSSSGGGAGSSNSGGGSGSGNMPASVAHVP AAMLPPNVIDTDFIDEEVLMSLVIEMGLDRIKELPELWLGQNEFDFMTDFVCKQQP SRVSCRPHACPAEGCDRRFSSPADLTRHLRIHTGHKPFQCRICMRSFSDSGNLRVHI RTHTGEKPFACEFCGRKFAQLAHLRAHAKIHLKQKEHACPAEGCDRRFSQRANLR AHLRIHTGHKPFQCRICMRSFSREDNLHTHIRTHTGEKPFACEFCGRKFARSDNLVR HAKIHLKQKEKKAEKGGAPSASSAPPVSLAPVVTTCA | SEQ ID NO: 38 |
| SEQ ID NO: 349 | MRPHACPAEGCDRRFSSPADLTRHLRIHTGHKPFQCRICMRSFSDSGNLRVHIRTHT GEKPFACEFCGRKFAQLAHLRAHAKIHLKQKEHACPAEGCDRRFSQRANLRAHLR NTGHKPFQCRICMRSFSREDNLHTHIRTHTGEKPFACEFCGRKFARSDNLVRHAKI HLKQKEKLEMADHLMLAEGYRLVQRPPSAAAAHGPHALRTLPPYAGPGLDSGLR PRGAPLGPPPPRQPGALAYGAFGPPSSFQPFPAVPPPAAGIAHLQPVATPYPGRAAA PPNAPGGPPGPQPAPSAAAPPPPAHALGGMDAELIDEEALTSLELELGLHRVRELPE LFLGQSEFDCFSDLGSAPPAGSVSC | SEQ ID NO: 38 |

TABLE 30-continued

GRN target regions and eTFs for upregulating expression of GRN

| eTF SEQ ID NO: | eTF sequence | Target site SEQ ID NO: |
|---|---|---|
| SEQ ID NO: 350 | MAADHLMLAEGYRLVQRPPSAAAAHGPHALRTLPPYAGPGLDSGLRPRGAPLGPP PPRQPGALAYGAFGPPSSFQPFFPAVPPPAAGIAHLQPVATPYPGRAAAPPNAPGGPP GPQPAPSAAAPPPPAHALGGMDAELIDEEALTSLELELGLHRVRELPELFLGQSEFD CFSDLGSAPPAGSVSCGGSGGGSGRPHACPAEGCDRRFSSPADLTRHLRIHTGHKPF QCRICMRSFSDSGNLRVHIRTHTGEKPFACEFCGRKFAQLAHLRAHAKIHLKQKEH ACPAEGCDRRFSQRANLRAHLRIHTGHKPFQCRICMRSFSREDNLHTHIRTHTGEK PFACEFCGRKFARSDNLVRHAKIHLKQKEKLEMADHLMLAEGYRLVQRPPSAAA AHGPHALRTLPPYAGPGLDSGLRPRGAPLGPPPPRQPGALAYGAFGPPSSFQPFPAV PPPAAGIAHLQPVATPYPGRAAAPPNAPGGPPGPQPAPSAAAPPPPAHALGGMDAE LIDEEALTSLELELGLHRVRELPELFLGQSEFDCFSDLGSAPPAGSVSC | SEQ ID NO: 38 |

TABLE 31

Exemplary DBDs of eTFs for upregulating GRN expression

| eTF SEQ ID NO: | DBD SEQ ID NO: | DBD Sequence |
|---|---|---|
| SEQ ID NO: 337 | SEQ ID NO: 377 | LEPGEKPYKCPECGKSFSTSHSLTEHQRTHTGEKPYKCPECGKSFSDCRDLARH QRTHTGEKPYKCPECGKSFSTTGNLTVHQRTHTGEKPYKCPECGKSFSDPGAL VRHQRTHTGEKPYKCPECGKSFSTHLDLIRHQRTHTGEKPYKCPECGKSFSHTG HLLEHQRTHTGKKTS |
| SEQ ID NO: 338 | SEQ ID NO: 378 | LEPGEKPYKCPECGKSFSRNDTLTEHQRTHTGEKPYKCPECGKSFSDPGALVRH QRTHTGEKPYKCPECGKSFSTSGELVRHQRTHTGEKPYKCPECGKSFSRSDNLV RHQRTHTGEKPYKCPECGKSFSTSGELVRHQRTHTGEKPYKCPECGKSFSTKNS LTEHQRTHTGKKTSKRPAATKKAGQAKKKK |
| SEQ ID NO: 339 | SEQ ID NO: 379 | LEPGEKPYKCPECGKSFSTSGNLTEHQRTHTGEKPYKCPECGKSFSRADNLTEH QRTHTGEKPYKCPECGKSFSSPADLTRHQRTHTGEKPYKCPECGKSFSQSSNLV RHQRTHTGEKPYKCPECGKSFSQRANLRAHQRTHTGEKPYKCPECGKSFSQLA HLRAHQRTHTGEKPYKCPECGKSFSHRTTLTNHQRTHTGKKTS |
| SEQ ID NO: 340 | SEQ ID NO: 380 | LEPGEKPYKCPECGKSFSSPADLTRHQRTHTGEKPYKCPECGKSFSDSGNLRVH QRTHTGEKPYKCPECGKSFSQLAHLRAHQRTHTGEKPYKCPECGKSFSQRANL RAHQRTHTGEKPYKCPECGKSFSREDNLHTHQRTHTGEKPYKCPECGKSFSRS DNLVRHQRTHTGKKTS |
| SEQ ID NO: 341 | SEQ ID NO: 381 | LEPGEKPYKCPECGKSFSSPADLTRHQRTHTGEKPYKCPECGKSFSDSGNLRVH QRTHTGEKPYKCPECGKSFSQLAHLRAHQRTHTGEKPYKCPECGKSFSQRANL RAHQRTHTGEKPYKCPECGKSFSREDNLHTHQRTHTGEKPYKCPECGKSFSRS DNLVRHQRTHTGKKTS |
| SEQ ID NO: 342 | SEQ ID NO: 382 | LEPGEKPYKCPECGKSFSSPADLTRHQRTHTGEKPYKCPECGKSFSDSGNLRVH QRTHTGEKPYKCPECGKSFSQLAHLRAHQRTHTGEKPYKCPECGKSFSQRANL RAHQRTHTGEKPYKCPECGKSFSREDNLHTHQRTHTGEKPYKCPECGKSFSRS DNLVRHQRTHTGKKTS |
| SEQ ID NO: 343 | SEQ ID NO: 383 | LEPGEKPYKCPECGKSFSSPADLTRHQRTHTGEKPYKCPECGKSFSDSGNLRVH QRTHTGEKPYKCPECGKSFSQLAHLRAHQRTHTGEKPYKCPECGKSFSQRANL RAHQRTHTGEKPYKCPECGKSFSREDNLHTHQRTHTGEKPYKCPECGKSFSRS DNLVRHQRTHTGKKTS |
| SEQ ID NO: 344 | SEQ ID NO: 384 | LEPGEKPYKCPECGKSFSTSHSLTEHQRTHTGEKPYKCPECGKSFSHKNALQNH QRTHTGEKPYKCPECGKSFSERSHLREHQRTHTGEKPYKCPECGKSFSSKKALT EHQRTHTGEKPYKCPECGKSFSQRANLRAHQRTHTGEKPYKCPECGKSFSRKD NLKNHQRTHTGEKPYKCPECGKSFSQSSNLVRHQRTHTGEKPYKCPECGKSFS QSSSLVRHQRTHTGEKPYKCPECGKSFSQAGHLASHQRTHTGKKTS |
| SEQ ID NO: 345 | SEQ ID NO: 385 | RKYPNRPSKTPPHERPYACPVESCDRRFSSPADLTRHIRIHTGQKPFQCRICMRN FSDSGNLRVHIRTHTGEKPFACDICGRKFAQLAHLRAHTKIHLRQKDRPYACPV ESCDRRFSQRANLRAHIRIHTGQKPFQCRICMRNFSREDNLHTHIRTHTGEKPFA CDICGRKFARSDNLVRHTKIHLRQKD |
| SEQ ID NO: 346 | SEQ ID NO: 386 | RKYPNRPSKTPPHERPYACPVESCDRRFSSPADLTRHIRIHTGQKPFQCRICMRN FSDSGNLRVHIRTHTGEKPFACDICGRKFAQLAHLRAHTKIHLRQKDRPYACPV ESCDRRFSQRANLRAHIRIHTGQKPFQCRICMRNFSREDNLHTHIRTHTGEKPFA CDICGRKFARSDNLVRHTKIHLRQKDK |

TABLE 31-continued

Exemplary DBDs of eTFs for upregulating GRN expression

| eTF SEQ ID NO: | DBD SEQ ID NO: | DBD Sequence |
|---|---|---|
| SEQ ID NO: 347 | SEQ ID NO: 387 | HACPAEGCDRRFSSPADLTRHLRIHTGHKPFQCRICMRSFSDSGNLRVHIRTHT GEKPFACEFCGRKFAQLAHLRAHAKIHLKQKEHACPAEGCDRRFSQRANLRAH LRIHTGHKPFQCRICMRSFSREDNLHTHIRTHTGEKPFACEFCGRKFARSDNLVR HAKIHLKQKE |
| SEQ ID NO: 348 | SEQ ID NO: 388 | HACPAEGCDRRFSSPADLTRHLRIHTGHKPFQCRICMRSFSDSGNLRVHIRTHT GEKPFACEFCGRKFAQLAHLRAHAKIHLKQKEHACPAEGCDRRFSQRANLRAH LRIHTGHKPFQCRICMRSFSREDNLHTHIRTHTGEKPFACEFCGRKFARSDNLVR HAKIHLKQKE |
| SEQ ID NO: 349 | SEQ ID NO: 389 | HACPAEGCDRRFSSPADLTRHLRIHTGHKPFQCRICMRSFSDSGNLRVHIRTHT GEKPFACEFCGRKFAQLAHLRAHAKIHLKQKEHACPAEGCDRRFSQRANLRAH LRIHTGHKPFQCRICMRSFSREDNLHTHIRTHTGEKPFACEFCGRKFARSDNLVR HAKIHLKQKE |
| SEQ ID NO: 350 | SEQ ID NO: 390 | MADHLMLAEGYRLVQRPPSAAAAHGPHALRTLPPYAGPGLDSGLRPRGAPLG PPPPRQPGALAYGAFGPPSSFQPFPAVPPPAAGIAHLQPVATPYPGRAAAPPNAP GGPPGPQPAPSAAAPPPPAHALGGMDAELEDEEALTSLELELGLHRVRELPELFL GQSEFDCFSDLGSAPPAGSVSC |

EXAMPLES

The following examples are included to further describe some aspects of the present disclosure, and should not be used to limit the scope of the invention.

Example 1

Increasing Gene Expression in HEK293T Cells

Figure 2:
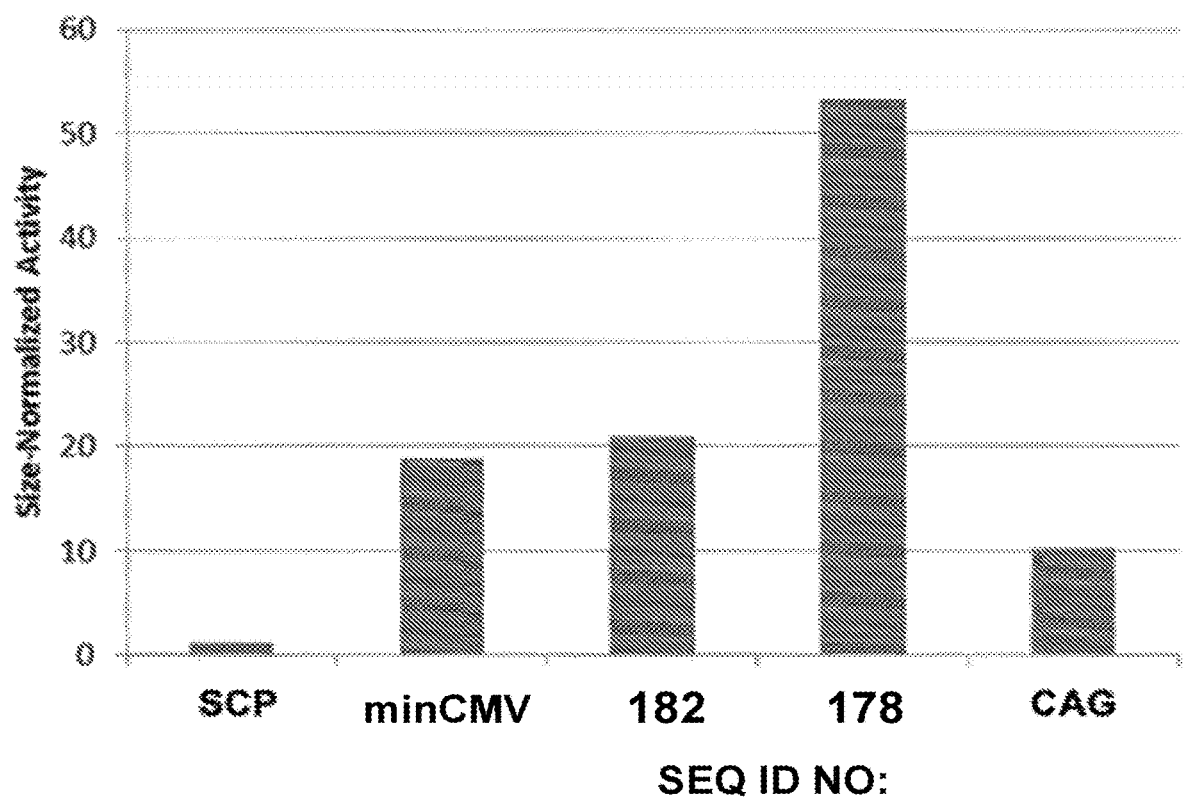
FIG. 2 illustrates the size-normalized activity (calculated by dividing the normalized luciferase activity as shown in FIG. 1 by the length of the regulatory element in base pairs) of each regulatory element.

HEK293T cells were transfected with plasmid DNA containing a luciferase gene under the control of one of several different regulatory elements, i.e., no promoter control; SCP; CMV; SEQ ID NO: 178 operably linked to minCMV; SEQ ID NO: 182 operably linked to minCMV; and CAG. The normalized luciferase values from each construct are illustrated in FIG. 1. The size normalized activity values from each construct are illustrated in FIG. 2. The constructs having a minCMV promoter linked to a regulatory element of SEQ ID NO: 178 or 182 drove higher levels of luciferase expression than minCMV alone and SCP alone.

This experiment indicated that and SEQ ID NOs: 178 and 182 are REs that drive high gene expression in a cell. Such REs can be added to an expression cassette disclosed herein comprising a non-naturally occurring transcriptional activator of SCN1A to increase expression of the transcriptional activator in a cell, which results in an increased expression of the endogenous SCN1A gene. In some cases, one or more REs selected from SEQ ID NOs: 178 and/or 182 are operably linked to a transcriptional activator to increase SCN1A expression in a cell. Such regulatory elements can be added to an expression cassette upstream and/or downstream of a transcriptional activator in an expression cassette.

Example 2

Selectivity for Parvalbumin Neurons

Selectivity for parvalbumin cells, a type of GABAergic neurons, was determined using fluorescent imaging. AAV vectors containing eGFP operably linked to either a control promoter (EF1a) or a PV-selective RE, and AAV vectors containing a CRE dependent tdTomato were co-injected into a GAD2-IRES-CRE mouse (Jackson Labs).

Mice were infused bilaterally with 1.54, of AAV vector ($5^{12}$ to $1^{13}$ gc/ml) into the dorsal and ventral hippocampus at a rate of 0.3 µL/min with a 4 min rest period following injection. Mice were anesthetized for the injection using Isoflurane (2%, 800 mL/min 02). Bupivacaine/epinephrine was used for local analgesia and carprofen was used for peri-/post-operative analgesia. The animals were placed in a stereotaxic frame (Kopf instruments, USA), using the following coordinates for the dorsal hippocampus (AP −2.0 mm, lateral ±1.5, DV −1.4 mm from dura) and the ventral hippocampus (AP −3.1 mm, lateral ±2.8, DV −3.8 mm from dura). A Hamilton syringe (model #80308; 10 µL syringe with corresponding 30 ga blunt tip needle) was used with the stereotactic micromanipulator, to designate and drill the bur holes. The drill was only used to penetrate the bone. Following drilling, the infusion cannula was lowered into the brain to the depth of the desired location. The injection settings for the ultra micropump III with micro4 controller (World Precision Instruments) were: injection volume: 1.5 µL; injection rate: 0.3 µL/min. The needle was slowly lowered (over approximately 1 minute) to DV −0.1 mm below the infusion coordinates (−1.5 mm for the dorsal hippocampus and −3.9 mm for the ventral hippocampus and then raised to DV −1.4 or −3.8, respectively). Prior to infusion, the needle was allowed to equilibrate for 1 minute. Once delivery was completed, the needle was left for 4 min and then withdrawn over approximately 1 min. Once all four infusions were complete, the skin incision was closed with sutures. The treated mice underwent daily health checks for the remainder of the study and were weighed once weekly to monitor body weight.

For tissue collection, mice were euthanized via isoflurane overdose and perfused with 4% Paraformaldehyde (PFA). A piece of brain tissue containing the hippocampus was extracted and placed in 4% PFA at 4° C. for at least 12 hours. The brain tissue was then dehydrated in 30% sucrose (in phosphate buffered saline) at 4° C. until the tissue sank to the bottom of the tube. Brain tissue was embedded in Tissue-Tek OCT for sectioning in a cryostat. Sectioned brain tissue was stained for eGFP and tdTomato using standard immunohistochemistry procedures with anti-RFP polyclonal rabbit antibody (Rockland Antibodies and Assay) and anti-eGFP polyclonal chicken antibody (Ayes Labs).

Figure 3:
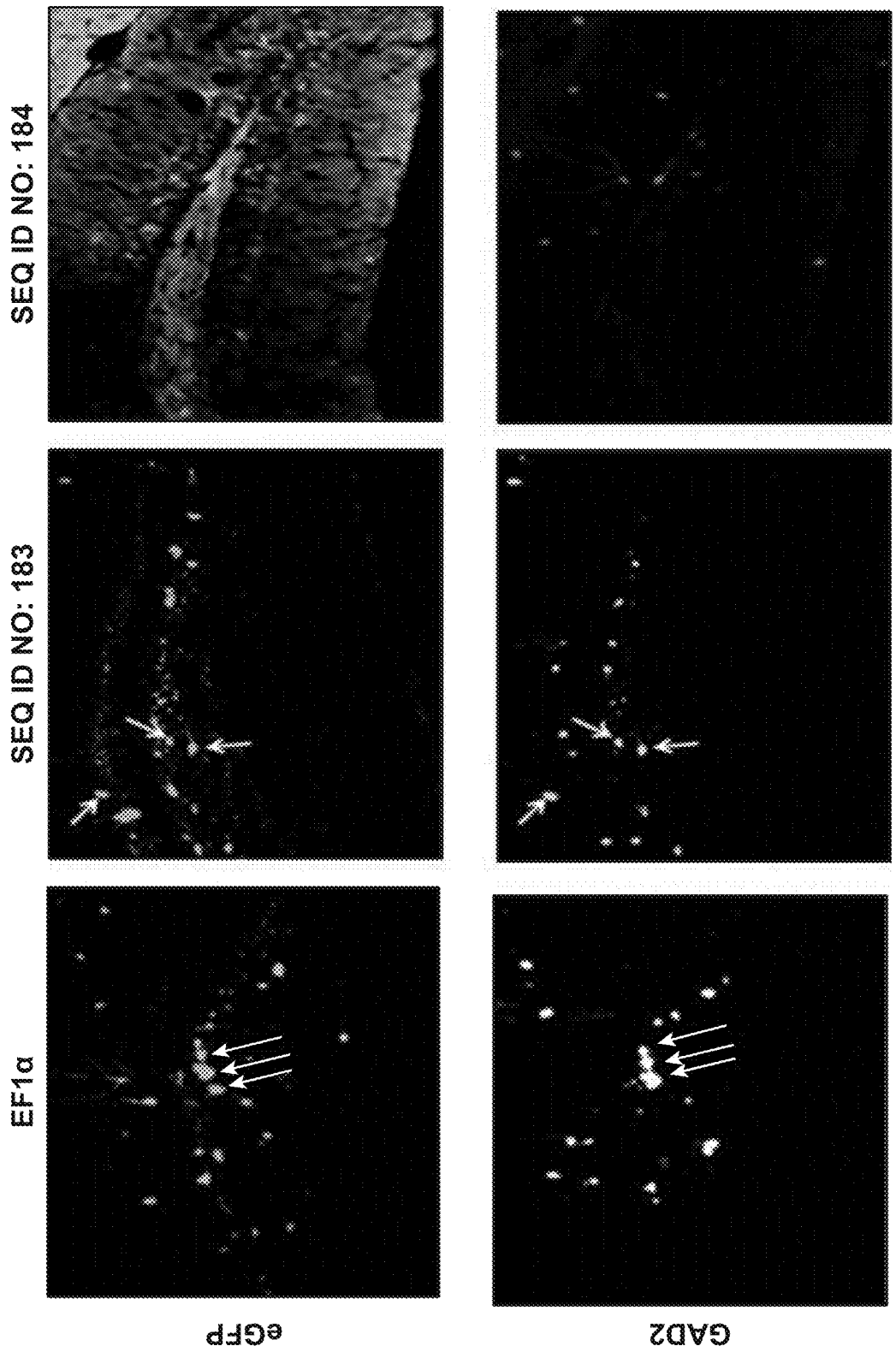
FIG. 3 illustrates selective expression of eGFP under the control of GABAergic-selective regulatory elements (REs), such as REs that are selective for parvalbumin (PV) cells. AAVDJ vectors containing eGFP, under the control of either an EF1α promoter or a GABAergic/PV-selective RE such as SEQ ID NO: 183, which includes SEQ ID NO: 185, or SEQ ID NO: 184, were injected into a mouse which expressed tdTomato (a red fluorescent protein (RFP)) in GABAergic/PV cells. Top row images show the pattern of eGFP expressed from a construct containing the EF1α promoter (SEQ ID NO: 186), the GABAergic/PV-selective RE SEQ ID NO: 183, or SEQ ID NO: 184. Lower row images show the GABAergic/PV neurons, which are GAD2-positive. Cells which express both eGFP and tdTomato can be identified either by overlaying the top row image with the lower image, or by identifying fluorescence from the same location in both the top row and lower row images. Examples of cells which express both eGFP and tdTomato are indicated with arrow heads.

FIG. 3 illustrates representative images from mice treated with an AAV vector containing eGFP and either a PV-selective element (SEQ ID NO: 183 or SEQ ID NO: 184) or the constitutive EF1α control promoter (SEQ ID NO: 186), along with a second AAV vector containing a tdTomato fluorescent reporter whose expression is dependent upon Cre recombinase activity. GAD2 is selectively expressed in GABAergic neurons, including PV neurons, thus, tdTomato expression identifies GABAergic neurons (FIG. 3, lower row).

Figure 4:
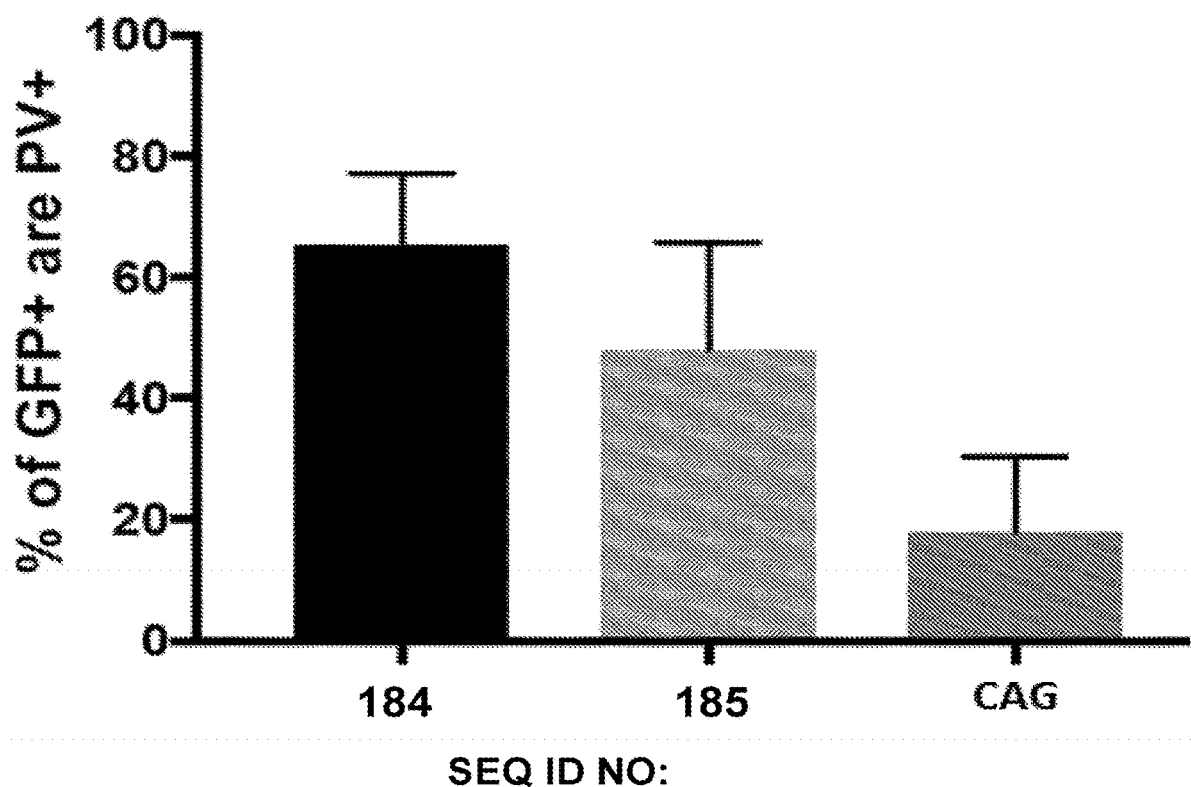
FIG. 4 illustrates quantification of efficiency of expression of eGFP by GABAergic/PV neurons in FIG. 3 (as measured, for example, as the percentage of tdTomato-expressing cells which also express eGFP).

FIG. 4 illustrates the efficiency of expression in PV cells for each promoter or regulatory element. eGFP expression driven by EF1α, a constitutive promoter, showed an efficiency of expression of about 40%. In contrast, eGFP expression driven by either SEQ ID NO: 183 (which comprises a promoter having a sequence of SEQ ID NO: 185) or SEQ ID NO: 184 showed an efficiency of expression of about 90%, showing much higher efficiency of expression than the EF1α promoter.

Figure 5:
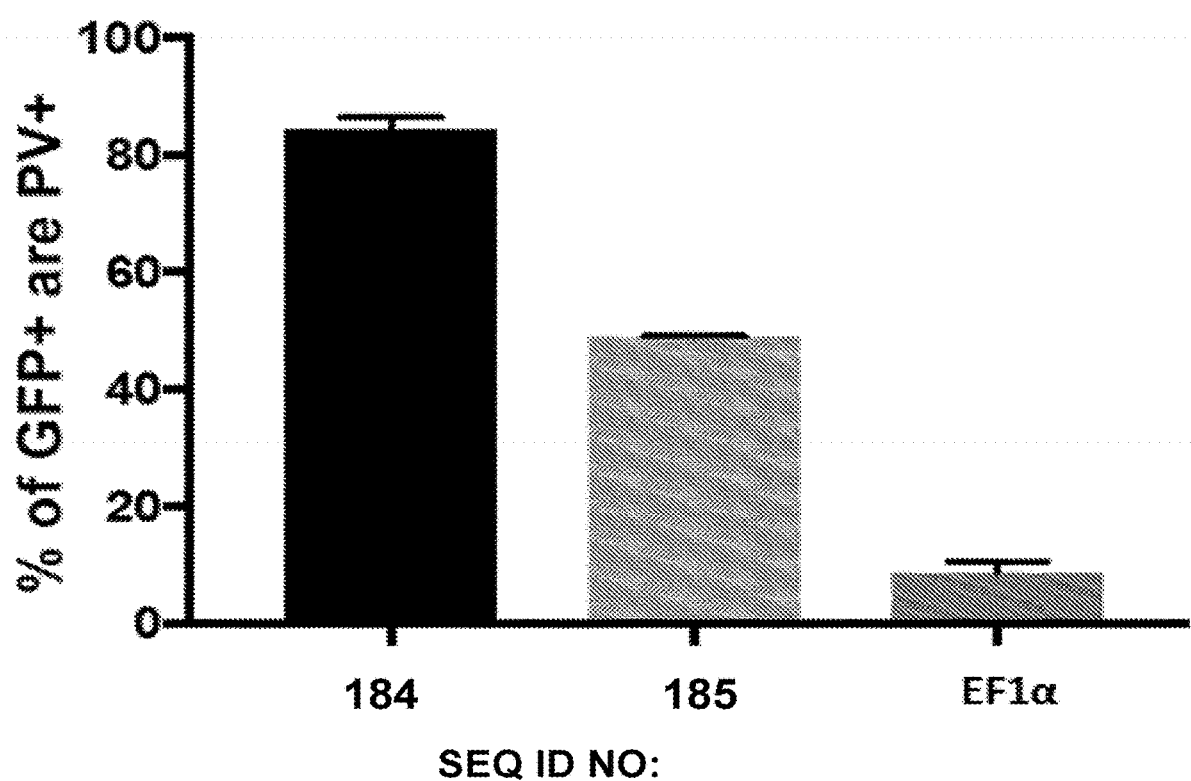
FIG. 5 illustrates quantification of specificity of expression of eGFP by GABAergic/PV neurons in FIG. 3 (as measured, for example, as the percentage of eGFP-expressing cells which also express tdTomato (or RFP+)).

FIG. 5 illustrates specificity of expression of the different regulatory sequences, SEQ ID NOs: 183 and 184 both drove expression of eGFP in PV cells with about 75% specificity, compared to EF1α promoter which showed less than 10% specificity for parvalbumin (PV) cells.

These experiments confirmed the selectivity of SEQ ID NO: 183 and 184 regulatory elements for GABAergic/PV neurons and illustrated assays that can be used to measure selectivity for GABAergic/PV cells. One or more of SEQ ID NOs: 183-184 regulatory elements can be included in an expression cassette described herein to increase selective expression of a transcriptional activator in GABAergic/PV cells as compared to non-GABAergic cells to minimize off-target effects, as determined using the assays described above. In some cases, one or more REs selective for PV cells are used in an expression cassette to increase selective expression of a transcriptional activator in PV cells as compared to non-PV cells, using similar assays as those described above.

Example 3

Identification of Target Regions Capable of Upregulating SCN1A Using SCN1A Specific Transcriptional Activators In order to identify regions of the genome capable of upregulating endogenous SCN1A expression, various engineered transcription factors (either zinc finger nucleases or gRNA/daCas9 constructs) were designed that targeted various regions of the genome as set forth in TABLEs 26-29 above. For gRNA/daCas9 constructs, the gRNA had the same sequence as the target region because the gRNA was designed to target the complementary genomic strand. Sequence of the dCas9 protein is SEQ ID NO: 104, which is also SEQ ID NO: 103 with NLS and HA tag.

HEK293 cells were cultured per standard methods, and transfected (FugeneHD, Promega) with 3 ug plasmid carrying an engineered transcription factor or control construct per well of a 6-well plate. Cells were transfected with plasmids expressing the constructs shown above in TABLE 26-29. 48 h following transfection, cells were collected and RNA was isolated (Qiagen RNeasy Mini kit), and DNase treated. RNA (3 ug) was reverse transcribed using OligoDT primers (Superscript IV, Invitrogen). cDNA samples were analyzed by qPCR using Phusion Polymerase (New England Biolabs) and SYBR Green I: (30 s at 98° C., 40×[10 sec at 98° C., 15 sec at 66° C., 15 sec at 72° C.]). Primers against SCN1A (5'-TGTCTCGGCATTGAGAACATTC-3' (SEQ ID NO: 190); 5'-ATTGGTGGGAGGCCATTGTAT-3' (SEQ ID NO: 191)) were used to quantify levels of endogenous SCN1A transcript, and relative levels of SCN1A expression were determined by the delta-delta Ct method with GAPDH as a reference gene (5'-ACCACAGTCCATGCCATCAC'-3' (SEQ ID NO: 192); 5'-TCCACCACCCTGTTGCTGTA-3' (SEQ ID NO: 193)). Data are presented as fold changes relative to the control condition.

Figure 6:
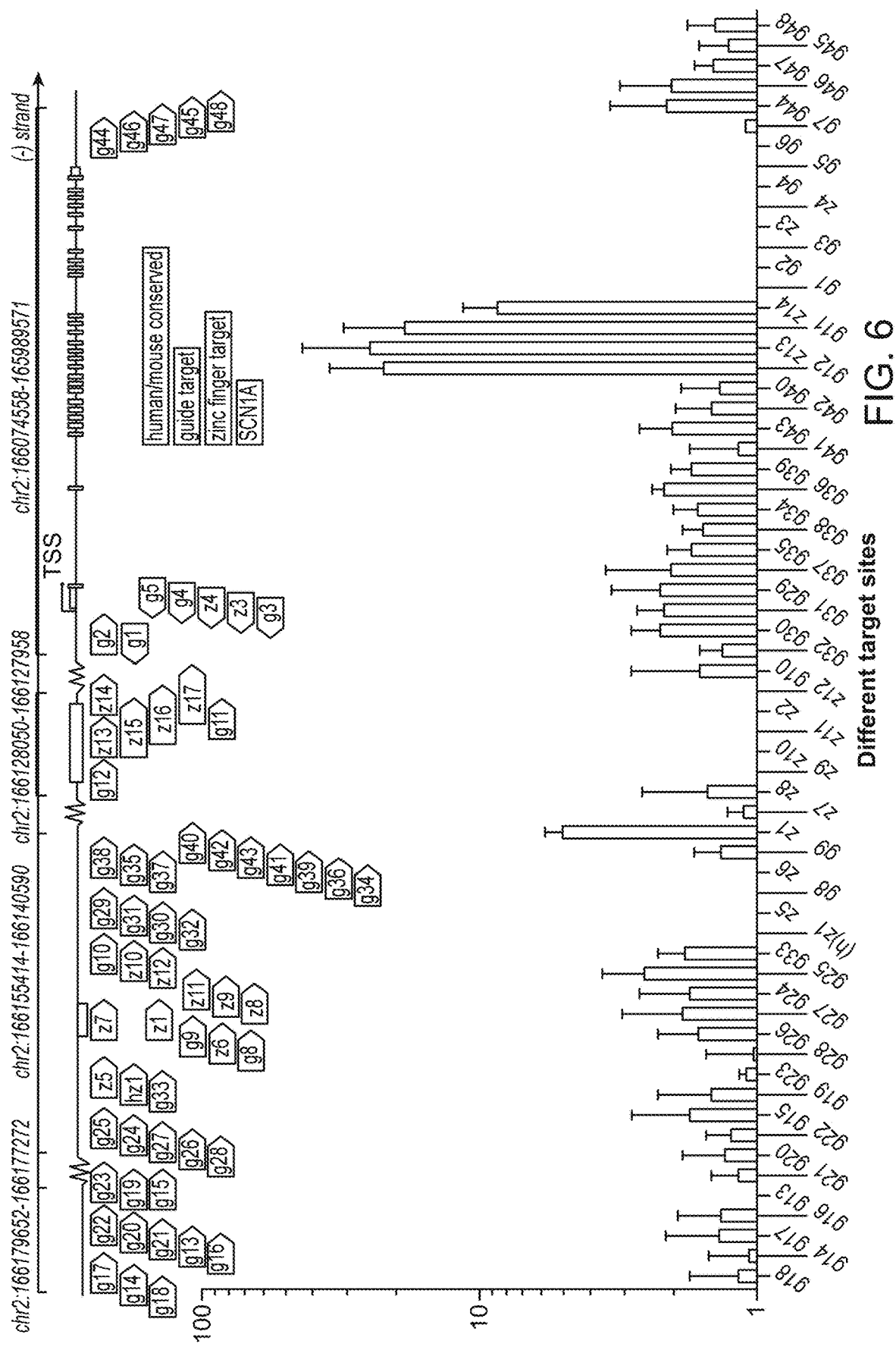
FIG. 6 illustrates upregulation of endogenous SCN1A using engineered transcription factors that bind to various regions on chromosome 2 (with reference to GRCh38.p12). Data are presented as fold change in SCN1A expression with respect to control (EGFP-KASH) condition.

The results are shown in FIG. 6 and in TABLE 32 below as fold change of SCN1A transcription relative to control conditions (e.g., EGFP-KASH reporter construct).

TABLE 32

Effect of different genomic target sites and corresponding eTFs had on transcription

| Target Site SEQ ID NO: | Target Sequence Recognized by eTF | Mean | Ttest |
|---|---|---|---|
| 197 | ggtacgggcaaagatttcttg | 1.36801947 | 0.48762102 |
| 198 | tttgcccgtaccaaagtcttg | 1.26748653 | 0.71262289 |
| 201 | ACACAATGAGCCACCTACAAG | 1.31187425 | 0.42605224 |
| 202 | GTGGCTCATTGTGTGTGTGCC | 1.25217773 | 0.26572657 |
| 203 | AGAAAGCTGATACAGATACAA | 1.7542842 | 0.34519408 |
| 203 | AGAAAGCTGATACAGATACAA | 1.45636874 | 0.44464045 |
| 207 | TTCTCAGTTTTGAAATTAAAA | 1.64498972 | 0.21705582 |
| 208 | CATATCCCTGCAGGTTCAGAA | 1.75688991 | 0.28984533 |
| 209 | TGGATTCTCTTCTGAACCTGC | 2.27026665 | 0.43195546 |
| 210 | agagagagagagagagagaga | 2.05701745 | 0.42409102 |
| 211 | TGGTCTCATTCTTTTTGTGGG | 1.71471378 | 0.32104302 |
| 107 | aaggctgtctaggtcaagtgt | 1.36378425 | 0.18753821 |
| 35 | ctaggtcaagtgtaggag | 5.12090848 | 0.0096628 |
| 257 | GGTCAAGTGTAGGAGACA | 1.52068773 | 0.62403349 |
| 224 | tgttcctccagattaacactt | 1.63040825 | 0.46710683 |
| 225 | ATTACAGTTCTGTCAGCATGC | 1.34500323 | 0.32186367 |
| 226 | ATCATCTGTAACCATCAAGGA | 2.58328006 | 0.0748197 |
| 227 | TCCTGCCTACTTAGTTTCAAG | 1.97097781 | 0.25980859 |
| 228 | TGCTGAGGCAGGACACAGTGT | 2.4290169 | 0.30364553 |
| 229 | ACAAAGTAAGTGTCAGTGTGG | 1.30739959 | 0.72725347 |
| 230 | CTGACACTTACTTTGTCTAAA | 1.95513108 | 0.02069095 |
| 231 | ATAATAGTTGTGTCTTTATAA | 1.55783618 | 0.29846459 |
| 232 | CGATATTTTCATGGATTCCTT | 1.7735976 | 0.21954265 |
| 233 | AAAACTGGAACCGCATTCCCA | 2.08698135 | 0.0454403 |
| 234 | TGTACAAGCAGGGCTGCAAAG | 1.4663605 | 0.02946062 |
| 235 | AAAGGGGAATGGGAACACCCG | 1.16749665 | 0.65768346 |

TABLE 32-continued

Effect of different genomic target sites and corresponding eTFs had on transcription

| Target Site SEQ ID NO: | Target Sequence Recognized by eTF | Mean | Ttest |
|---|---|---|---|
| 236 | ATGTTCAAGGTGCAGAAGGAA | 2.04547409 | 0.09880194 |
| 237 | ttcaacaagctcccaagaagt | 1.46929899 | 0.24465271 |
| 238 | GTTAACAAATACACTAAACAC | 1.37399196 | 0.33638238 |
| 109 | gctgatttgtattaggtacca | 22.4892633 | 0.09291316 |
| 36 | taggtaccatagagtgag | 25.4730028 | 0.14942042 |
| 108 | gatgaagccgagaggatactg | 18.7579211 | 0.13148732 |
| 136 | gaggatactgcagaggtc | 8.6766618 | 0.16432794 |
| 247 | TGTTTGCTCAAACGTGCACCA | 2.13402102 | 0.25583999 |
| 248 | AAATATGTACCAAGAAATG | 2.29522738 | 0.41829497 |
| 249 | TATCTGGTTTCTCTCACTGCT | 1.44542116 | 0.0947106 |
| 250 | AAATAAGACATGAAAACAAGA | 1.27016182 | 0.32368695 |
| 251 | ATTGCAAAGCATAATTTGGAT | 1.42246971 | 0.18117243 |

Example 4

Relative Expression of SCN1A from an Expression Cassette

This example describes relative expression of SCN1A from various expression cassettes comprising a non-naturally occurring transcriptional modulator which increases expression of the SCN1A gene. The SCN1A gene belongs to a family of genes that provide instructions for making sodium ion channels. These channels, which transport positively charged sodium atoms (sodium ions) into cells, play a key role in a cell's ability to generate and transmit electrical signals. To test the expression cassette, HEK293 cells were cultured per standard methods, and transfected (PEI) with 3 μg plasmid per well of a 6-well plate. 48 h following transfection, cells were collected and RNA was isolated (Qiagen RNeasy Mini kit), and DNase treated. RNA (3 μg) was reverse transcribed using OligoDT primers (Superscript IV, Invitrogen). cDNA samples were analyzed by qPCR using Phusion Polymerase (New England Biolabs) and SYBR Green I: (30 s at 98° C., 40×[10 sec at 98° C., 15 sec at 66° C., 15 sec at 72° C.]).

Various expression cassettes were constructed, including a control expression cassette comprising an eGFP reporter transgene and lacks a transcriptional activator; and expression cassettes A-H as described in TABLE 17 above. For expression cassettes A-F, each comprised a non-naturally occurring DNA binding domain that comprised six to nine zinc fingers according to SEQ ID NOs: 103, 131-134 linked to either a VP64 transcriptional activation domain having a sequence of SEQ ID NO: 95 or a VPR transcriptional activation domain having a sequence of SEQ ID NO: 114. Such non-naturally occurring transcriptional activators were engineered to bind a target site having a sequence of any one of SEQ ID NOs: 35-37, 107-108, or 136, or a genomic region comprising any one of SEQ ID NOs: 35-37, 107-108, or 136. Expression cassettes G and H each comprised a dSaCas9 DNA binding domain having a sequence of SEQ ID NO: 103 linked to a VP64 transcriptional activation domain having a sequence of SEQ ID NO: 95. Each G and H expression cassette also comprised a gRNA for targeting the non-naturally occurring transcriptional activator, wherein each gRNA comprised a sequence selected from SEQ ID Nos: 107-108. Each expression cassette also comprised a RE having a sequence of SEQ ID NO: 178.

Primers against SCN1A (5'-TGTCTCGGCATTGAGAACATTC-3' (SEQ ID NO: 190); 5'-ATTGGTGGGAGGCCATTGTAT-3' (SEQ ID NO: 191)) were used to quantify levels of endogenous SCN1A transcript, and relative levels of SCN1A expression were determined by the delta-delta Ct method with GAPDH as a reference gene (5'-ACCACAGTCCATGCCATCAC'3' (SEQ ID NO: 192); 5'-TCCACCACCCTGTTGCTGTA-3' (SEQ ID NO: 193)).

Figure 7:
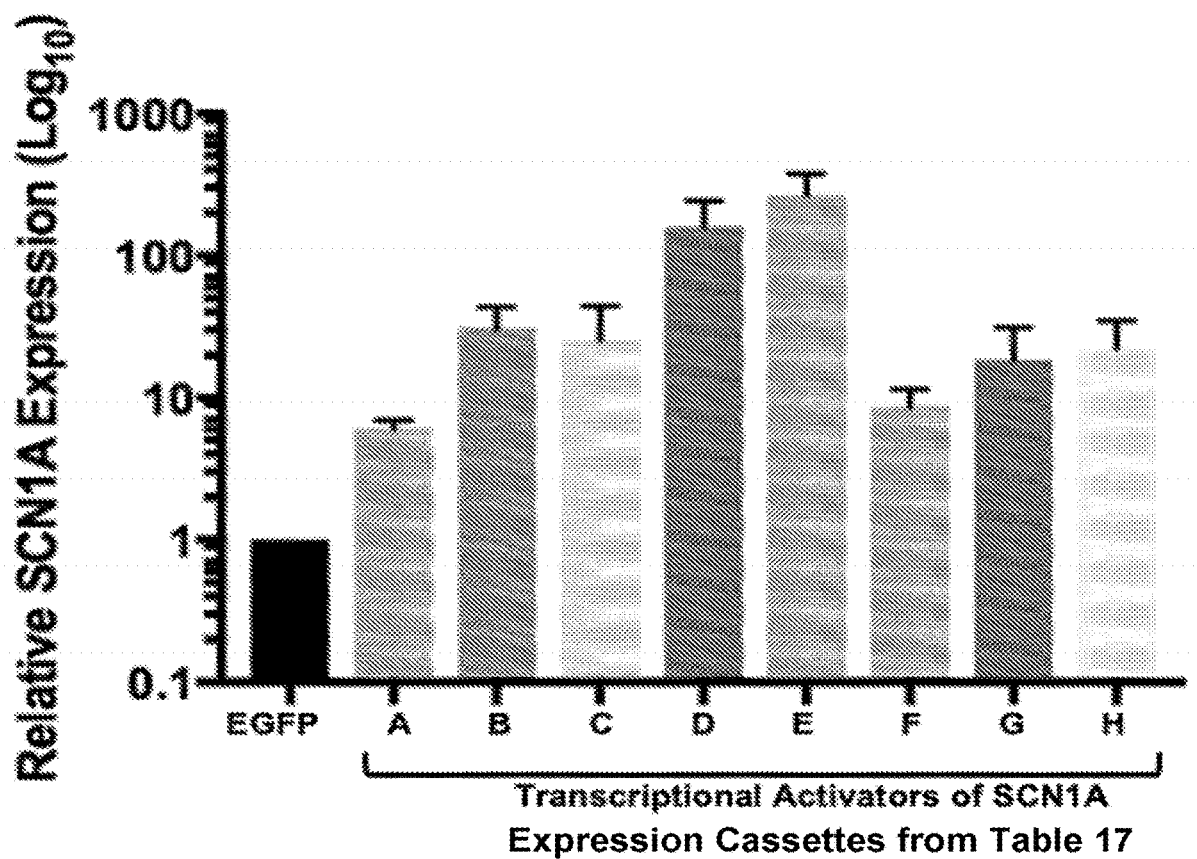
FIG. 7 illustrates the relative expression of SCN1A presented as fold change relative to the eGFP control in $Log_{10}$.

FIG. 7 illustrates the relative expression of SCN1A for cells transfected with different expression cassettes, presented as fold change ($Log_{10}$) relative to the control eGFP construct. The expression of the non-naturally occurring transcriptional activators from expression cassettes A-H resulted in an increase in SCN1A gene expression in HEK293 cells relative to the control expression cassette.

Figure 8:
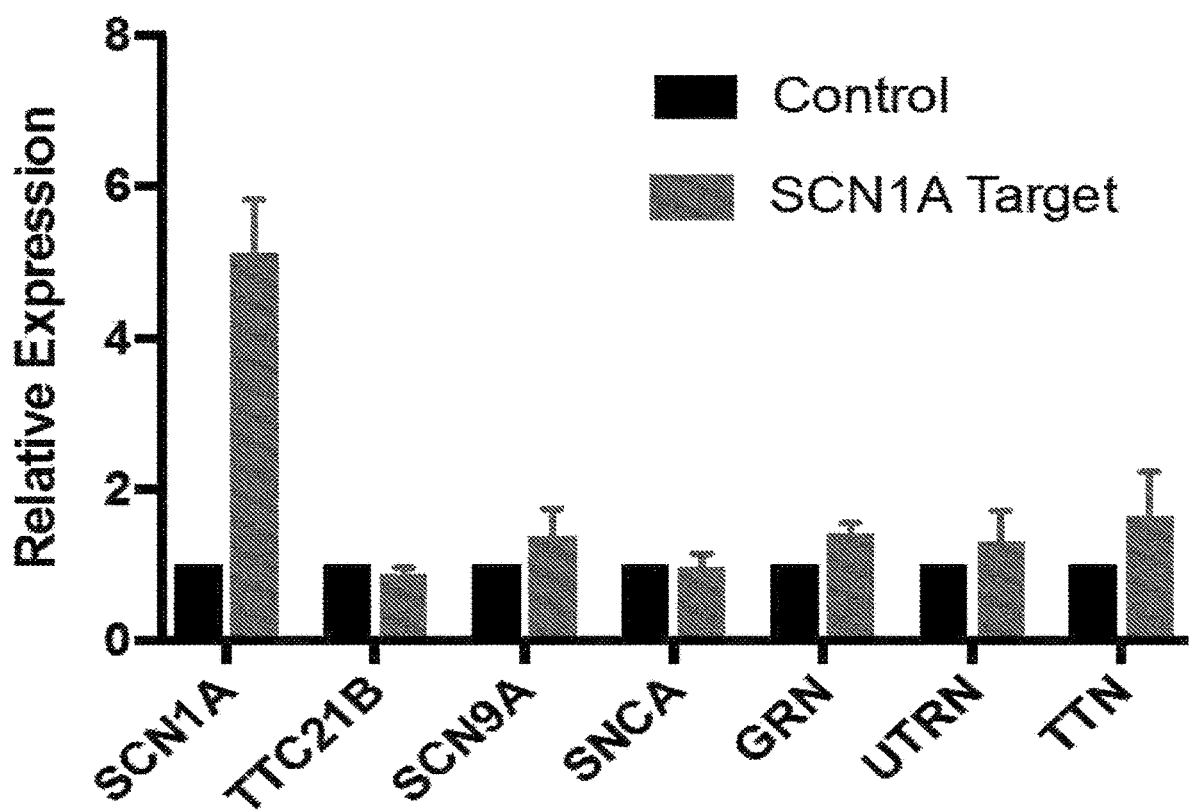
FIG. 8 illustrates the relative expression of endogenous SCN1A, TTC21B, SCN9A, SNCA, GRN, UTRN, and TTN transcripts presented as fold changes relative to the control.
Figure 9A:
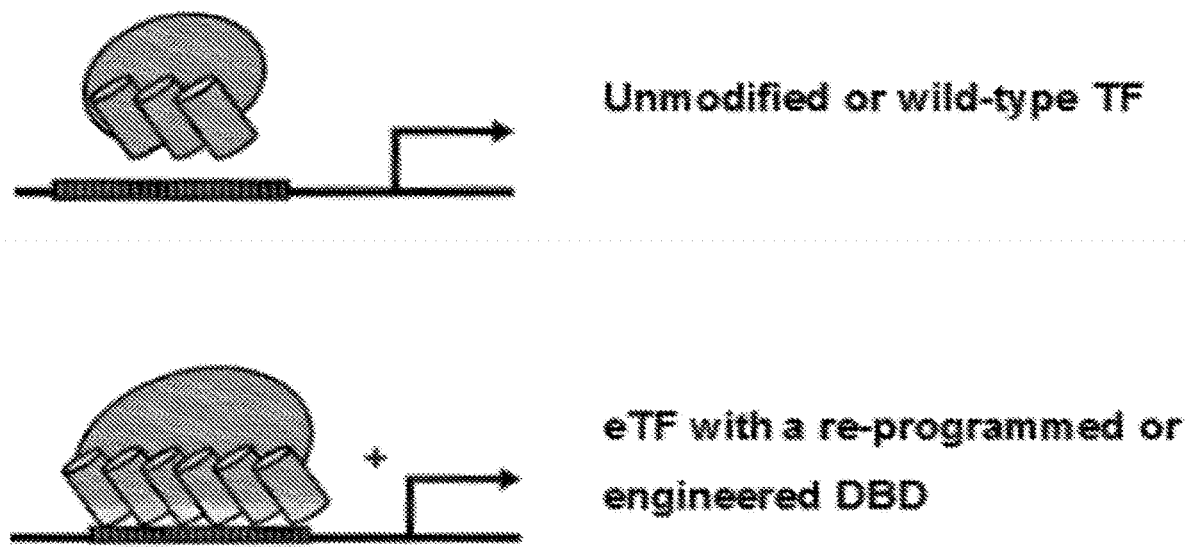
FIG. 9A illustrates one embodiment of an eTF disclosed herein, wherein the DNA binding domain (DBD) of a naturally occurring human transcription factor (TF) has been modified, reprogrammed, or engineered to recognize a target binding site at or near a gene target of interest. The top figure illustrates a naturally occurring transcription factor with no binding affinity to a target site (represented by a black bar) associated with an endogenous gene of interest or a gene target. The lower figure illustrates an eTF, wherein the DBD, comprising multiple zinc fingers (represented by cylinders) that have been modified, engineered, or reprogrammed to bind to a target site of a gene of interest, e.g., by duplicating or triplicating zinc fingers of the naturally occurring DBD and/or making amino acid substitutions in the zinc fingers.
Figure 9B:
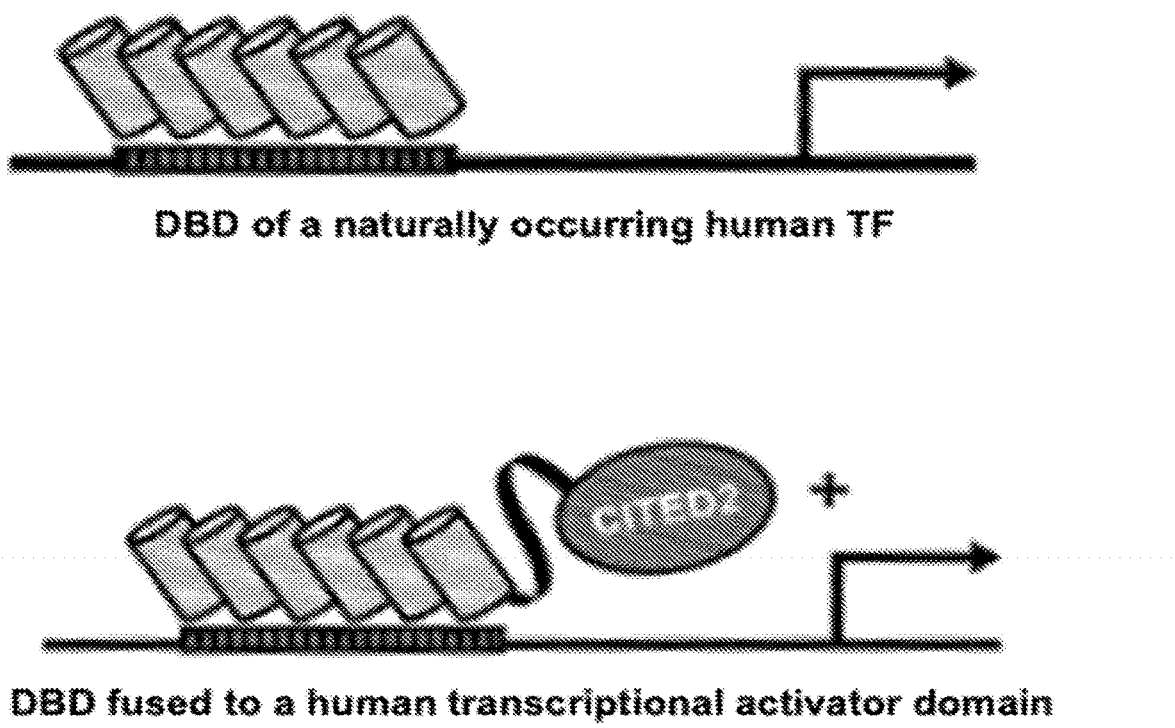
FIG. 9B illustrates another embodiment of an eTF disclosed herein, or a hybrid eTF, comprising a DBD derived from a naturally occurring human TF fused to a transactivating domain (TAD) of a human co-regulator protein or a transcription cofactor, e.g., TAD of a Cbp/p300-interacting transactivator protein such as CITED2 or CITED4. The top figure illustrates a DBD derived from a human protein and engineered to bind specifically to a desired target site in the genome (black bar). The lower figure illustrates the DBD fused to a TAD, e.g., TAD of CITED2, to form a hybrid eTF. Such hybrid eTF drives expression of a target gene by binding to the target site sequence in the genome and modulating (e.g., activating) transcription of the gene target via the TAD in the eTF.
Figure 10:
FIG. 10 illustrates the percentage conservation (or sequence identity) between various transcription modulating proteins and naturally occurring human protein and their sizes in base pairs (bp). In various embodiments, eTFs of this disclosure can be encoded by 1,000-1,800 bp of nucleic acid sequence and comprise >90% global sequence identity (i.e., sequence identity over the full-length amino acid sequence of the eTF) to a naturally occurring human protein, which can reduce immune response or immunogenicity when delivered into a cell or in vivo, e.g., via gene therapy. In comparison, dCas9-based transcription factors, comprising a deactivated Cas9 (dCas9) domain, have no global sequence identity to endogenous human proteins and are larger in size. Conventionally constructed zinc finger proteins (ZFPs), or artificial or synthetic DNA binding proteins comprising zinc fingers designed in silico, can be smaller in size, but have lower sequence identity (about 55%) to endogenous human proteins.
Figure 11:
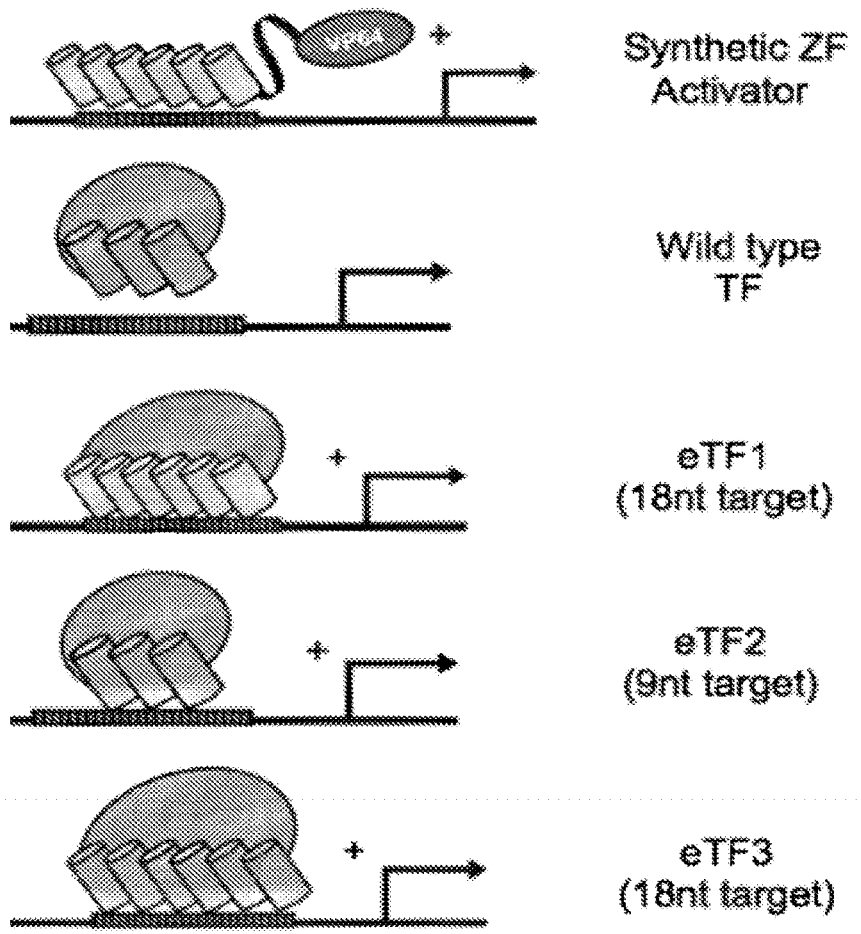
FIG. 11 illustrates various approaches for modulating an endogenous gene. In the top figure, a transcription modulator protein comprises a DBD comprising multiple synthetic zinc fingers (ZFs), such as ZFs designed in silico, fused to a transactivation domain (TAD) of VP64. In the second figure, a wild type TF is naturally occurring, but does not bind to a target site of a gene of interest. In the third figure, an eTF comprises a naturally occurring TF whose DBD has been modified or reprogrammed to bind to an 18 nt target site at or near a gene of interest, e.g, wherein the DBD of the wild-type TF is replaced with synthetic zinc fingers. In the fourth figure, an eTF is derived from the wild-type TF, wherein the DBD is engineered to recognize a 9 nt target binding site at or near the gene of interest. In the bottom figure, an eTF is derived from the wild-type TF, wherein the DBD of the wild-type TF has been duplicated and reprogrammed (e.g., via amino acid substitutions in the ZFs) to form a 6-zinc finger DBD that recognizes an 18 nt target binding site at or near the gene of interest. These various embodiments of eTFs can be assayed using a reporting activation assay, wherein the gene target is a report gene (e.g., EGFP). eTFs in the top, third, fourth, and fifth figures result in expression of the reporter gene.

FIG. 8 illustrates expression cassette A comprising a non-naturally occurring transcriptional activator that was used to increase expression of the SCN1A gene, as compared to other genes, in HEK293 cells. In addition, primers against TTC21B (5'-GGTCACGTACAGCTTCGCAT-3' (SEQ ID NO: 283); 5'-CTGGTTTCTGGCTCGTGGAG-3' (SEQ ID NO: 284)), SCN9A (5'-AAGCCCCAAAGCCAAGCAG-3' (SEQ ID NO: 285); 5'-AGGTGTGGCATTGAAACGG-3' (SEQ ID NO: 286)), GRN (5'-ATGGTCAGTTCTGCCCTGTG-3'(SEQ ID NO: 287); 5'-CGGTAAAGATGCAGGAGTGGC-3' (SEQ ID NO: 288)), UTRN (5'-TGACAATGGGCAGAACGAAT-3' (SEQ ID NO: 289); 5'-TGCAGCACTCTGTTGACGTT (SEQ ID NO: 290)), and TTN (5'-TGTTGCCACTGGTGCTAAAG-3' (SEQ ID NO: 291); 5'-ACAGCAGTCTTCTCCGCTTC-3' (SEQ ID NO: 292)) were used to quantify levels of endogenous TTC21B, SCN9A, GRN, UTRN, and TTN transcripts, and relative levels of expression of these genes were determined by the delta-delta Ct method with GAPDH as a reference gene, using primers having sequences of SEQ ID NOs: 192-193.

FIG. 8 illustrates the relative expression of endogenous SCN1A, TTC21B, SCN9A, GRN, UTRN, and TTN transcripts presented as fold changes relative to the control condition. Expression cassette A, as described above, was able to specifically increase expression of the SCN1A gene, or the Nav1.1 protein, as compared to the other genes tested. This indicated the target site recognized by the transcriptional activator of expression cassette A was specific for the SCN1A gene, thus resulting in an increase in SCN1A gene expression in HEK293 cells.

Example 5

SCN1A Activation

Figure 12A:
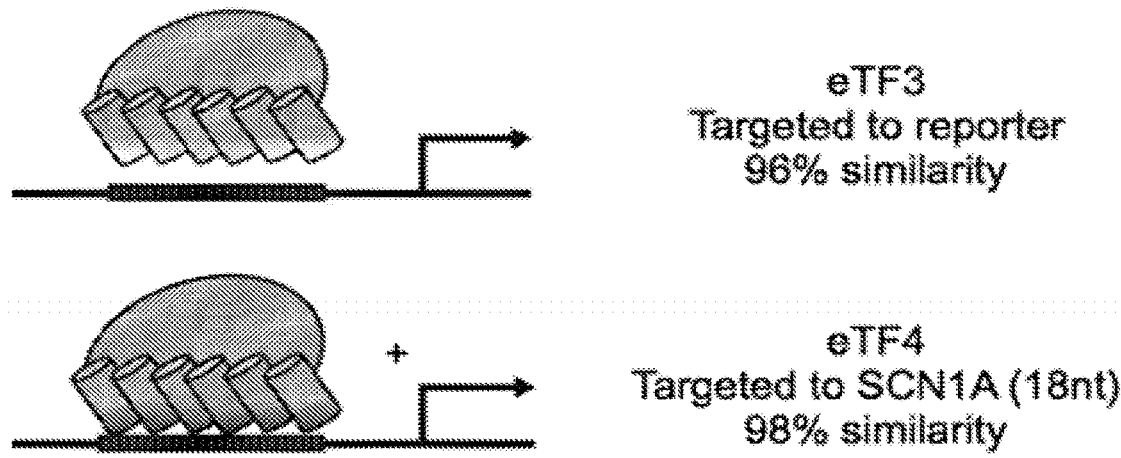
FIG. 12A illustrates schematics of SCN1A activation assay, wherein expression of SCN1A in HEK293 cells is indicative of binding to a SCN1A-specific target binding site and activation of SCN1A gene expression by an eTF. The top figure illustrates an eTF engineered to recognize the TRE binding site for EGFP reporter gene, which fails to bind to the SCN1A target binding site and thus fails to express SCN1A. The lower figure illustrates an eTF derived from a naturally occurring human protein, comprising at least 98% sequence identity to the human protein and a DBD engineered to bind to an 18 nt SCN1A target binding site, results in SCN1A gene activation and thus SCN1A expression.
Figure 12B:
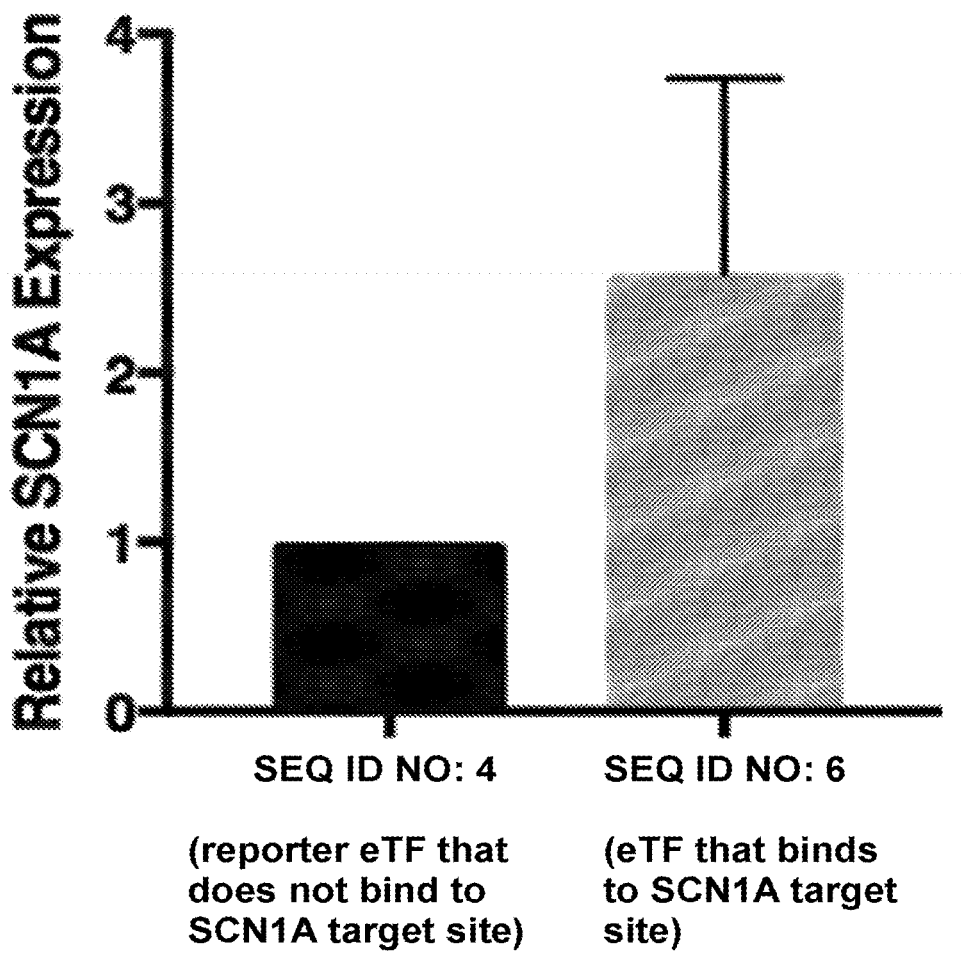
FIG. 12B illustrates quantification of the results of the SCN1A activation assay with exemplary eTFs illustrated in FIG. 12A. An eTF comprising six zinc fingers (SEQ ID NO: 6) with high global or overall sequence identity to EGR1 and wherein its DBD was engineered to recognize a specific binding site near or at endogenous SCN1A gene resulted in 2.5-fold expression of SCN1A in transfected HEK293 cells as compared to SEQ ID NO: 4, whose DBD was engineered to recognize the TRE binding site, not a SCN1A target binding site.
Figure 13A:
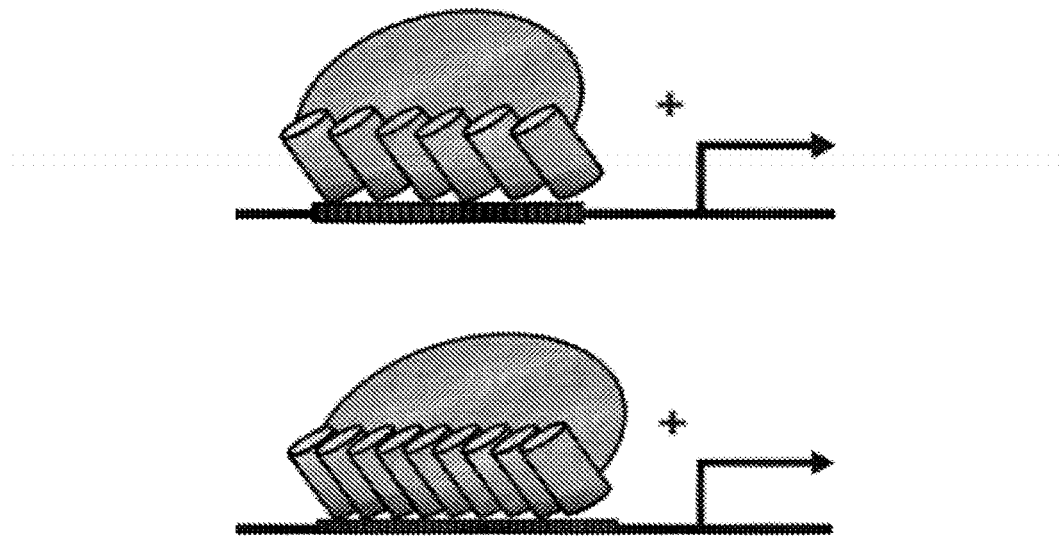
FIG. 13A illustrates schematics of SCN1A activation by two exemplary eTFs, each derived from a naturally occurring human protein. The top figure illustrates an eTF wherein the DBD of a naturally occurring human protein (e.g., EGR1 or EGR3) is duplicated to form a DBD having 6 zinc fingers and modified or reprogrammed to bind to a target binding site near or at endogenous SCN1A gene. The lower figure illustrates an eTF wherein the DBD of a naturally occurring human protein is triplicated to form a DBD having 9 zinc fingers and modified or reprogrammed to bind to a target binding site near or at endogenous SCN1A gene.
Figure 13B:
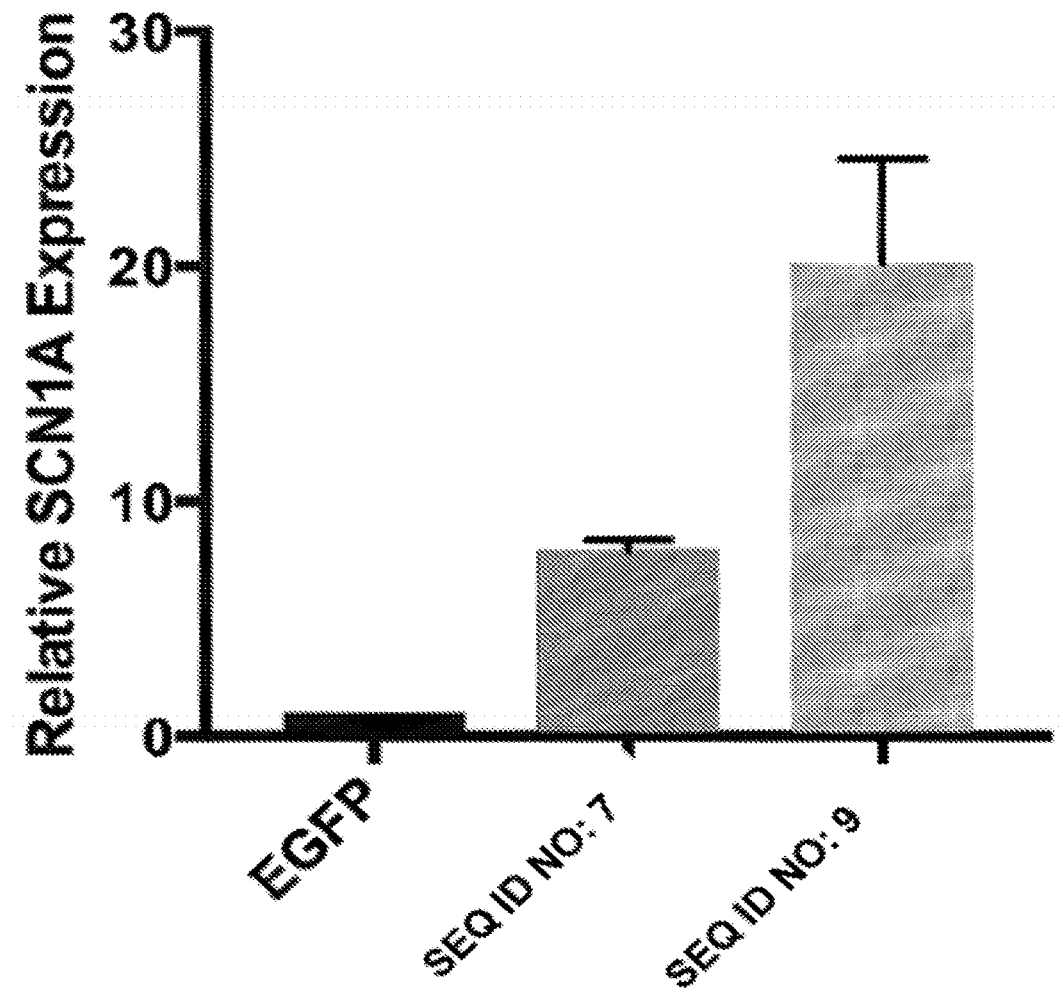
FIG. 13B illustrates quantification of the relative SCN1A expression activated by each of the eTFs illustrated in FIG. 13A. In transfected HEK293 cells, an eTF (SEQ ID NO: 7) comprising high sequence identity to EGR1 and a 6-zinc finger DBD derived from EGR1 and engineered to recognize a SCN1A target binding site resulted in about 7-fold SCN1A expression relative to an empty vector control. An eTF (SEQ ID NO: 9) comprising high sequence identity to EGR1 and a 9-zinc finger DBD derived from EGR1 and engineered to recognize a SCN1A target binding site resulted in about 20-fold SCN1A expression relative to the control.
Figure 14:
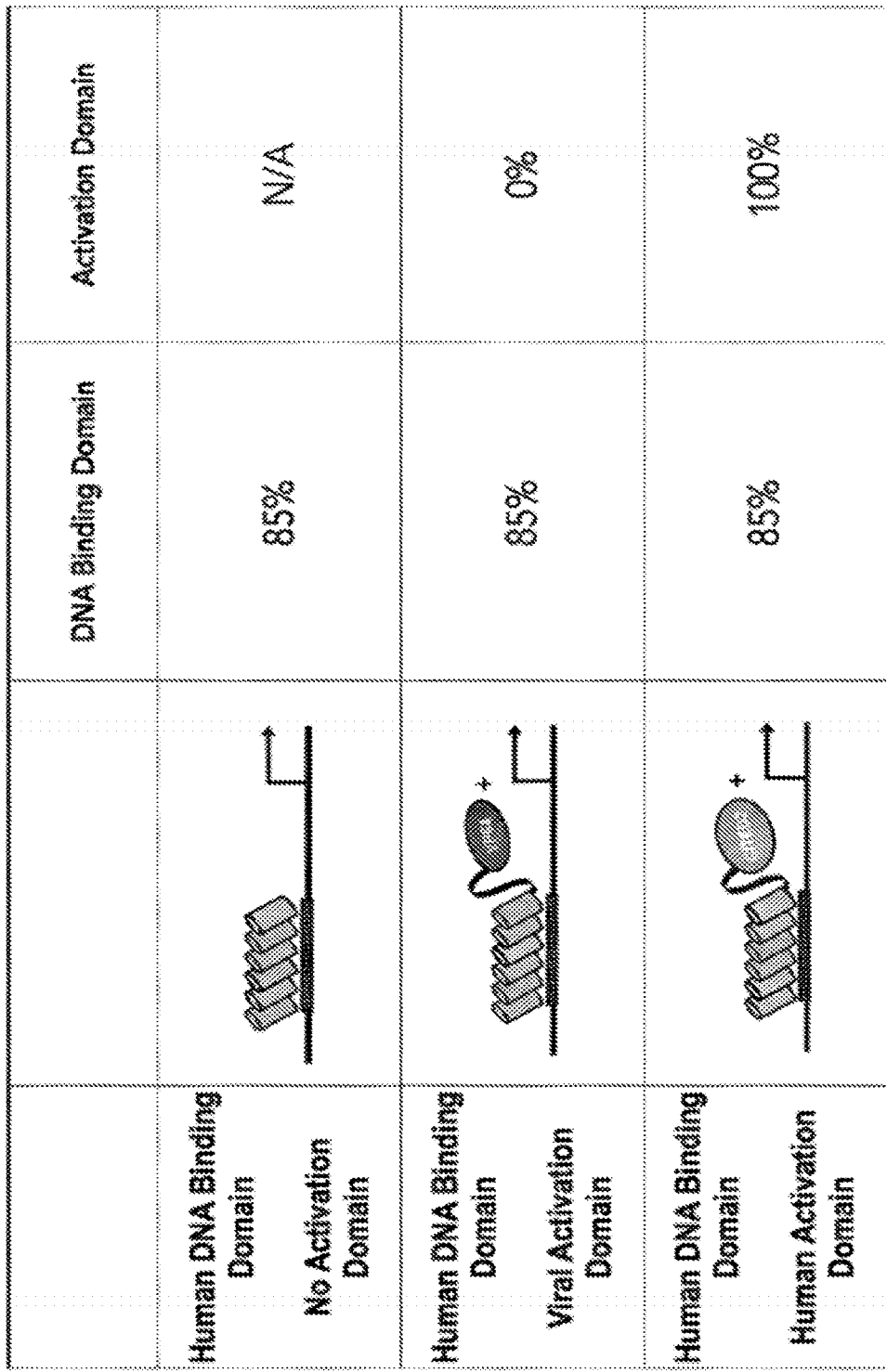
FIG. 14 illustrates various embodiments of hybrid eTFs comprising a human DBD having high sequence identity to a naturally occurring human protein fused to a TAD of another protein, such as a viral activation domain or a TAD of another human protein, such as CITED2. In various embodiments, local sequence identity between the DBD of the eTF and the DBD of a naturally occurring human protein is at least 85%. Such DBD can be fused to various activation domains, e.g., a viral activation domain such as VP64, which has 0% sequence identity to a human protein; or a CITED2 activation domain. Replacement of the VP64 domain with the human CITED sequence increases the overall sequence identity of the hybrid eTF in the third row as compared to a naturally occurring human protein.

HEK293 cells were cultured per standard methods, and transfected (FuGene HD, Promega) with 3 ug of each tested activator, or an EGFP control. 48 h following transfection, cells were collected and RNA was isolated (Qiagen RNeasy Mini kit), and DNase treated. RNA (3 ug) was reverse transcribed using OligoDT primers (Superscript IV, Invitrogen). cDNA samples were analyzed by qPCR using Phusion Polymerase (New England Biolabs) and SYBR Green I: (30 s at 98° C., 40×[10 sec at 98° C., 15 sec at 68° C., 15 sec at 72° C.]). Primers against human SCN1A (5'-TGTCTCGG-CATTGAGAACATTC-3' (SEQ ID NO: 190); 5'-ATTGGTGGGAGGCCATTGTAT-3' (SEQ ID NO: 191)) were used to quantify levels of reporter-driven EGFP transcript, and relative levels of EGFP expression were determined by the delta-delta Ct method with GAPDH as a reference gene (5'-ACCACAGTCCATGCCATCAC-3' (SEQ ID NO: 192); 5'-TCCACCACCCTGTTGCTGTA-3' (SEQ ID NO: 193)). Data are presented as fold changes relative to the control condition. See FIG. 12B and FIG. 13B. SEQ ID NOs: 6, 7, and 9 are eTFs derived from human EGR1 protein and are engineered to bind to a target site near or at endogenous SCN1A gene, wherein the target site is SEQ ID NOs: 35-37. As compared to reporter EGFP control, eTFs comprising any one of SEQ ID NOs: 6, 7, or 9 resulted in relative SCN1A expression of at least 2-fold, 7-fold, or 20-fold, respectively.

Example 6

Upregulation of Endogenous SCN1A in HEK293 Cells Using SCN1A Specific Transcription Factors HEK293 cells were cultured per standard methods, and transfected (FugeneHD, Promega) with 3 ug plasmid carrying an engineered transcription factor or EGFP control construct per well of a 6-well plate. Cells were transfected with plasmids containing the constructs shown below in TABLE 33. 48 h following transfection, cells were collected and RNA was isolated (Qiagen RNeasy Mini kit), and DNase treated. RNA (3 ug) was reverse transcribed using OligoDT primers (Superscript IV, Invitrogen). cDNA samples were analyzed by qPCR using Phusion Polymerase (New England Biolabs) and SYBR Green I: (30 s at 98° C., 40×[10 sec at 98° C., 15 sec at 66° C., 15 sec at 72° C.]). Primers against SCN1A (5'-TGTCTCGGCATTGAGAA-CATTC-3' (SEQ ID NO: 190); 5'-ATTGGTGGGAGGC-CATTGTAT-3' (SEQ ID NO: 191)) were used to quantify levels of endogenous SCN1A transcript, and relative levels of SCN1A expression were determined by the delta-delta Ct method with GAPDH as a reference gene (5'-ACCACAGTCCATGCCATCAC'3' (SEQ ID NO: 192); 5'-TCCACCACCCTGTTGCTGTA-3' (SEQ ID NO: 193)). Data are presented as fold changes relative to the control condition (see FIG. 15). The control construct consisted of EGFP expressed under the control of a promoter having a sequence according to SEQ ID NO: 178. Delivery of engineered transcription factors induced varying degrees of upregulation in endogenous SCN1A transcript with respect to the EGFP condition.

TABLE 33

Figure 15:
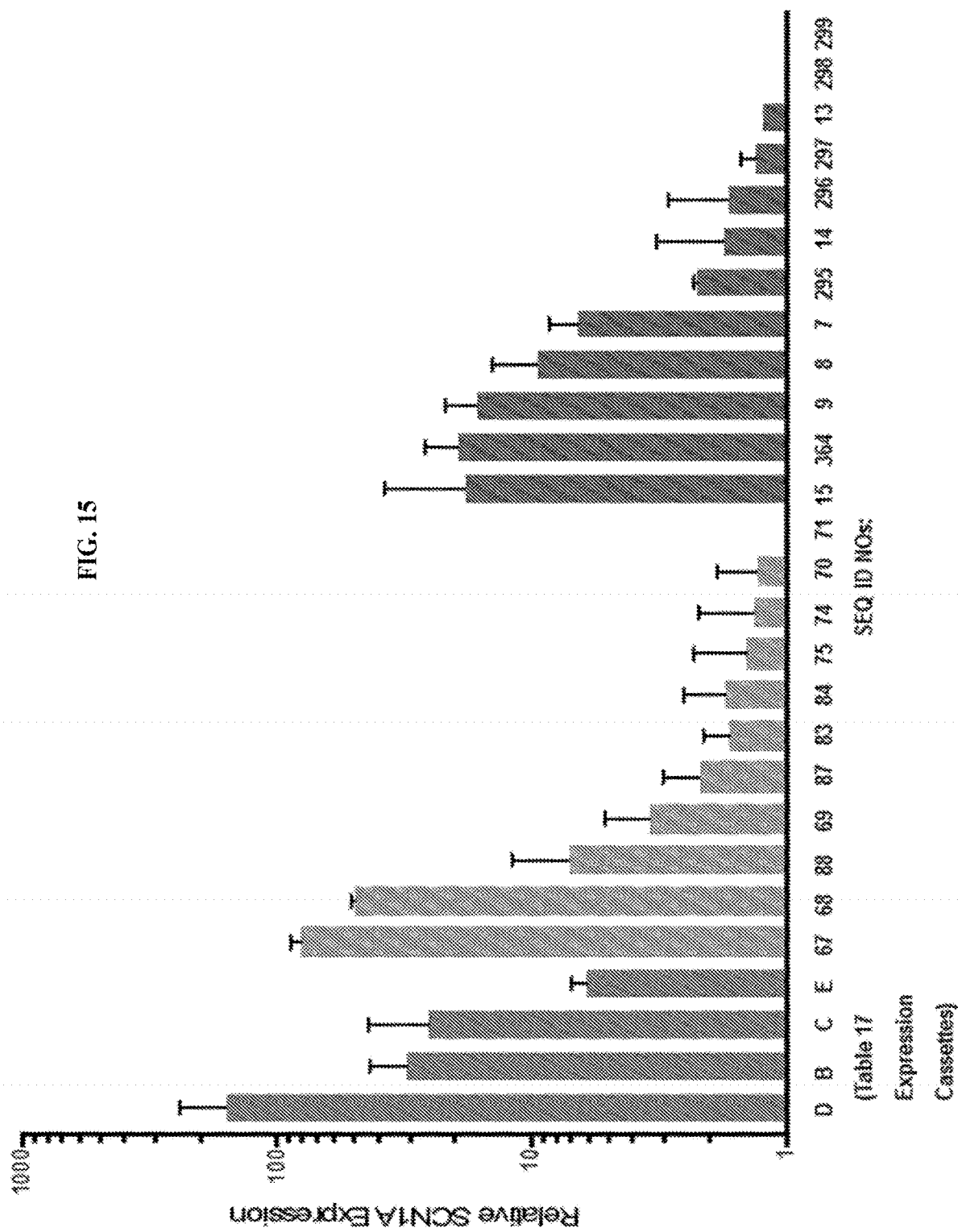
FIG. 15 illustrates the relative expression of endogenous SCN1A in HERK293 cells using SCN1A-specific transcriptional activators (see TABLEs 33-34 in Example 6). Data are presented as fold change relative to control conditions, and shown on a $Log_{10}$ scale.

Constructs used in Example 6 and FIG. 15.
eTF SEQ ID NO:

| | |
|---|---|
| Expression Cassette D in TABLE 17 | SEQ ID NO: 15 |
| Expression Cassette B in TABLE 17 | SEQ ID NO: 364 |
| Expression Cassette C in TABLE 17 | SEQ ID NO: 9 |
| Expression Cassette E in TABLE 17 | SEQ ID NO: 8 |
| SEQ ID NO: 67 | SEQ ID NO: 7 |
| SEQ ID NO: 68 | SEQ ID NO: 295 |
| SEQ ID NO: 88 | SEQ ID NO: 14 |
| SEQ ID NO: 69 | SEQ ID NO: 296 |
| SEQ ID NO: 87 | SEQ ID NO: 297 |

TABLE 33-continued

Constructs used in Example 6 and FIG. 15.
eTF SEQ ID NO:

| | |
|---|---|
| SEQ ID NO: 83 | SEQ ID NO: 13 |
| SEQ ID NO: 84 | SEQ ID NO: 298 |
| SEQ ID NO: 75 | SEQ ID NO: 299 |
| SEQ ID NO: 74 | |
| SEQ ID NO: 70 | |
| SEQ ID NO: 71 | |

TABLE 34

Constructs used in Example 6 and FIG. 15.

| eTF SEQ ID NO: | DBD SEQ ID NO: |
|---|---|
| SEQ ID NO: 364 | SEQ ID NO: 406 |
| SEQ ID NO: 295 | SEQ ID NO: 407 |
| SEQ ID NO: 296 | SEQ ID NO: 408 |
| SEQ ID NO: 299 | SEQ ID NO: 409 |

Example 7

Figure 16A:
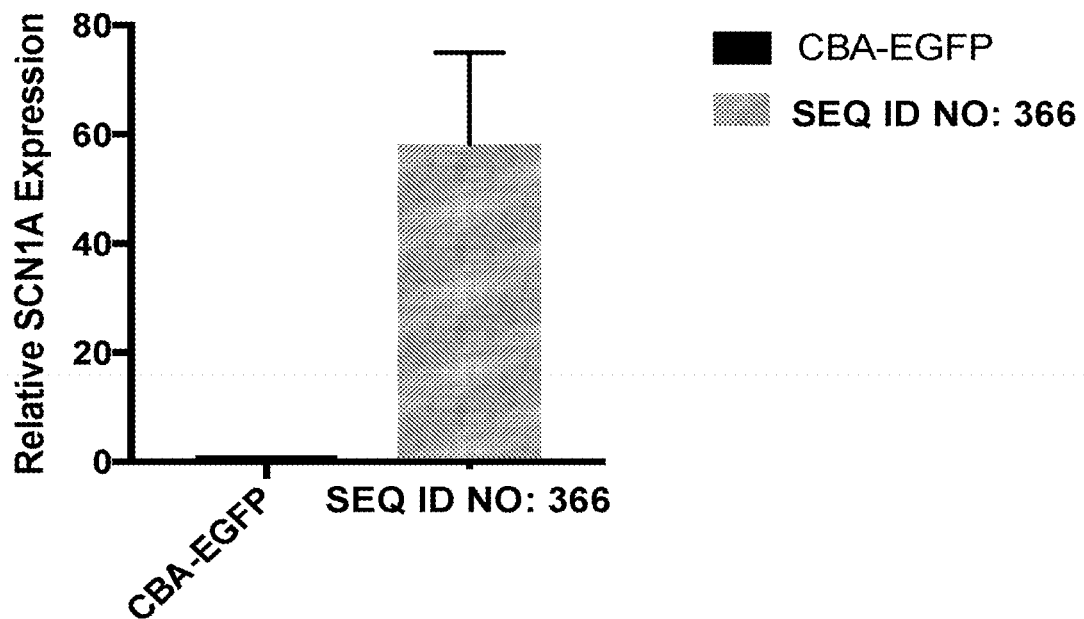
FIG. 16A illustrates the relative expression of endogenous SCN1A in GABA neurons using an SCN1A-specific transcriptional activator (SEQ ID NO: 366). Data are presented as fold change relative to control conditions (CBA-EGFP).
Figure 16B:
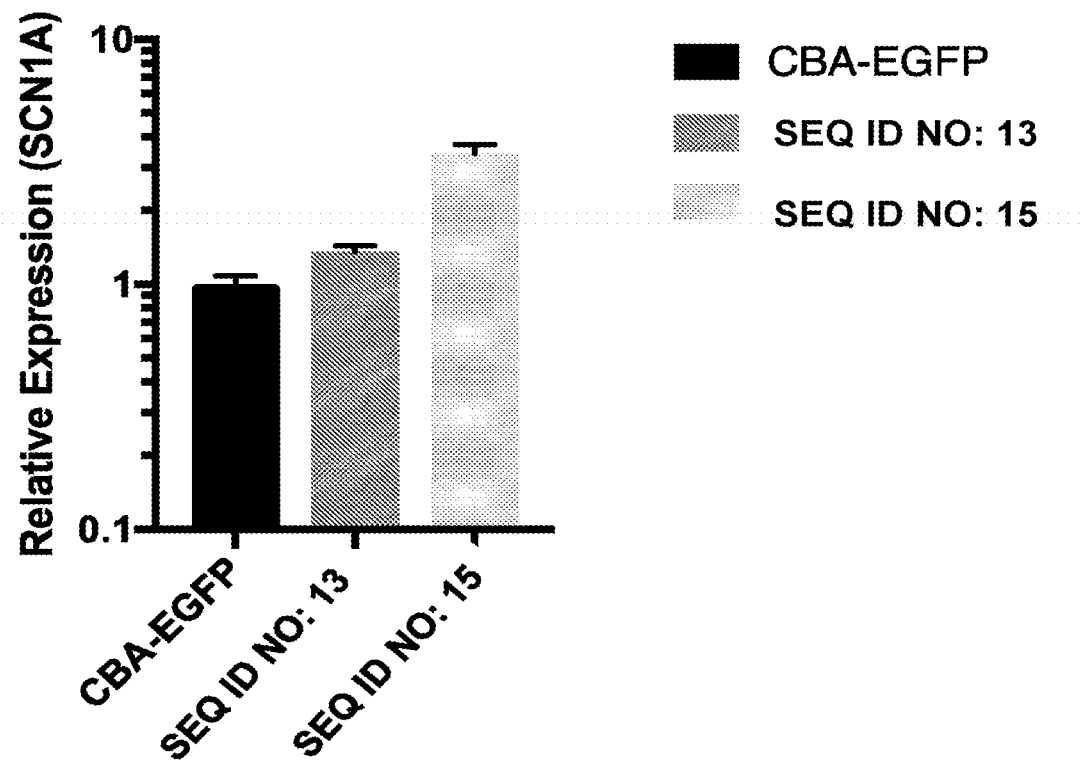
FIG. 16B illustrates the relative expression of endogenous SCN1A in GABA neurons using SCN1A-specific transcriptional activators (SEQ ID NO: 13 or SEQ ID NO: 15). Data are presented as fold change relative to control conditions (CBA-EGFP) in $Log_{10}$.

Upregulation of Endogenous SCN1A in GABA Neurons Using SCN1A Specific Transcription Factors iCell GABA neurons (Cellular Dynamics) were plated in a 6-well plate (~1E6 cells/well) and maintained per manufacturer's recommended protocol. 72 h following plating, recombinant AAV (serotype AAV-DJ) expressing EGFP or an activator (SEQ ID NO: 366 in FIG. 16A or SEQ ID NO: 13 or SEQ ID NO: 15 in FIG. 16B) under the control of a ubiquitous promoter (CBA promoter) was added to the culture media at approximately 2E11 genome copies/well. One week (FIG. 16A) or two weeks (FIG. 16B) following infection, RNA was isolated from cultured cells (Qiagen RNeasy Mini kit), and DNase treated. Recovered RNA was reverse transcribed using OligoDT primers (Superscript IV, Invitrogen). cDNA samples were analyzed by qPCR using Phusion Polymerase (New England Biolabs) and SYBR Green I: (30 s at 98° C., 40×[10 sec at 98° C., 15 sec at 66° C., 15 sec at 72° C.]). Primers against SCN1A (5'-TGTCTCGGCATTGAGAACATTC-3' (SEQ ID NO: 190); 5'-ATTGGTGGGAGGCCATTGTAT-3' (SEQ ID NO: 191)) were used to quantify levels of endogenous SCN1A transcript, and relative levels of SCN1A expression were determined by the delta-delta Ct method with GAPDH as a reference gene (5'-ACCACAGTCCATGCCATCAC'3' (SEQ ID NO: 192); 5'-TCCACCACCCTGTTGCTGTA-3' (SEQ ID NO: 193)). Data are presented as fold changes relative to the control condition (see FIG. 16A and FIG. 16B). AAV-driven expression of engineered transcription factors produced significant upregulation of endogenous SCN1A transcript in cultured iPS-derived GABA neurons.

Example 8

Specific Upregulation of Endogenous SCN1A in GABA Neurons Using an SCN1A Specific Transcription Factor iCell GABA neurons (Cellular Dynamics) were plated in a 6-well plate (~1E6 cells/well) and maintained per manufacturer's recommended protocol. 72 h following plating, recombinant AAV (serotype AAV-DJ) expressing EGFP or activator (SEQ ID NO: 366, which comprises a zinc finger DBD fused to a VPR TAD driven by a CBA promoter) under the control of a CBA promoter was added to the culture media at approximately 2E11 genome copies/well.

Figure 17:
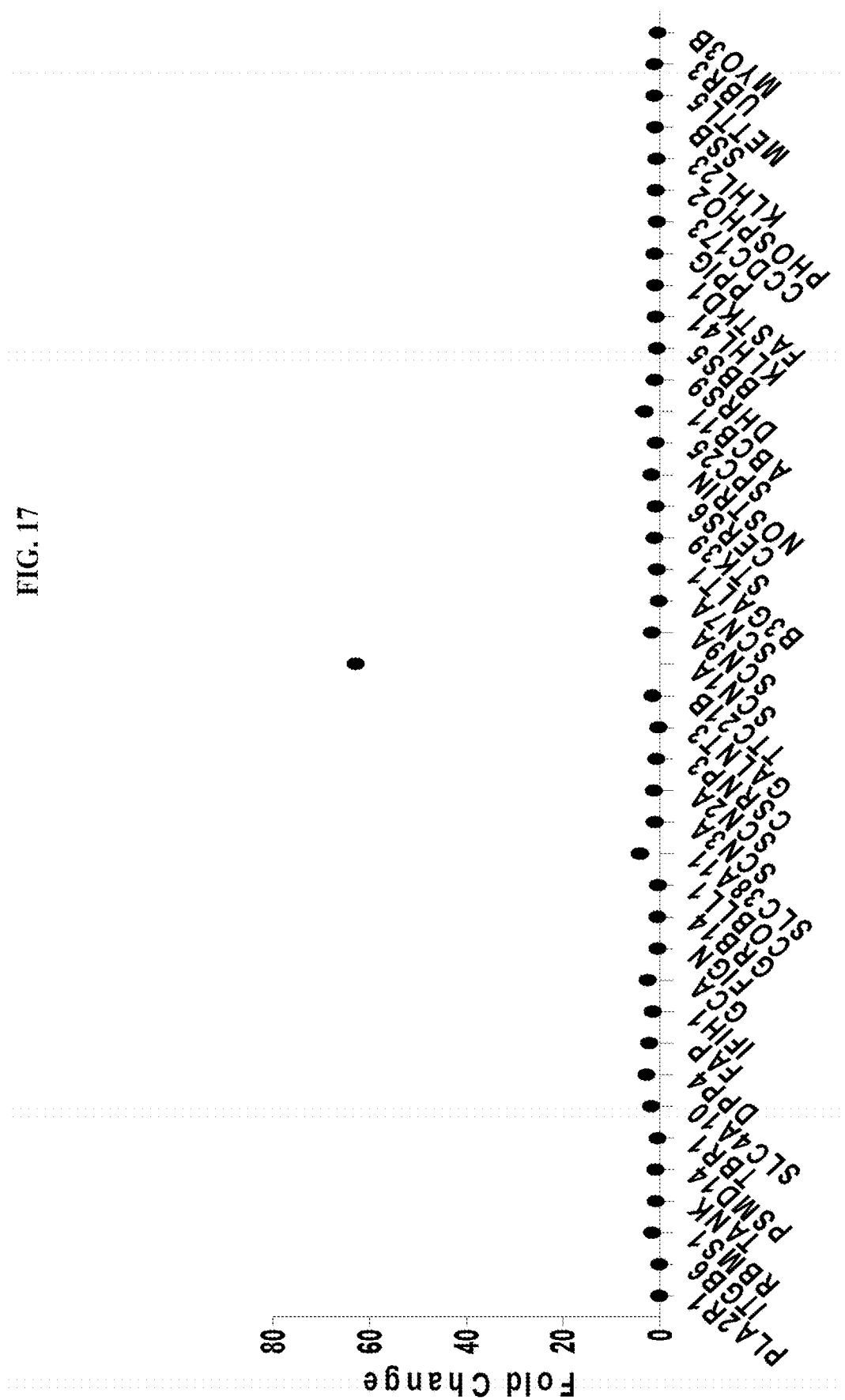
FIG. 17 illustrates the relative expression of endogenous SCN1A and the 40 nearest neighboring genes driven by an SCN1A specific transcription factor SEQ ID NO: 366). Data are presented as fold change relative to control conditions (CBA-EGFP-KASH) in $Log_{10}$.

One week following infection, RNA was isolated from cultured cells (Qiagen RNeasy Mini kit), and DNase treated. RNAseq libraries were prepared from the recovered RNA, using the TruSeq Stranded mRNA library kit (Illumina) and sequenced on an Illumina NextSeq (2×75 cycle paired end sequencing). Sequencing reads were aligned to human genome (RNASTAR) and differential expression analysis was performed with DESeq2. Data are presented as fold change with respect to control (AAVDJ-CBA-EGFP) samples (see FIG. 17). Results are shown in TABLE 35 and FIG. 17 illustrates the relative expression of endogenous SCN1A and the 40 nearest neighboring gene transcripts presented as fold changes relative to the control condition. SEQ ID NO: 366, as described above, was able to specifically increase expression of the SCN1A gene, or the Nav1.1 protein, as compared to the other genes examined. This indicated the target site recognized by the transcriptional activator of SEQ ID NO: 366 was specific for the SCN1A gene, thus resulting in an increase in SCN1A gene expression in GABA neurons.

TABLE 35

Effects on transcription of endogenous SCN1A and the 40 nearest neighbor genes in GABA neurons treated with an SCN1A specific transcription factor (SEQ ID NO: 366).

| Gene Name | Chr 2 Start | Chr 2 End | Chr Strand | Fold Change vs. Control |
|---|---|---|---|---|
| PLA2R1 | 160788518 | 160919121 | − | 0.16367458 |
| ITGB6 | 160956176 | 161128399 | − | 0.20679884 |
| RBMS1 | 161128661 | 161350305 | − | 1.63514667 |
| TANK | 161993418 | 162092732 | + | 0.90946407 |
| PSMD14 | 162164548 | 162268228 | + | 0.92699237 |
| TBR1 | 162272604 | 162282381 | + | 0.53199642 |
| SLC4A10 | 162280842 | 162841792 | + | 1.89407328 |
| DPP4 | 162848750 | 162931052 | − | 2.82345284 |
| FAP | 163027193 | 163101661 | − | 2.26977379 |
| IFIH1 | 163123588 | 163175213 | − | 1.46146481 |
| GCA | 163175349 | 163228105 | + | 2.58702426 |
| FIGN | 164449905 | 164592522 | − | 0.46785861 |
| GRB14 | 165349321 | 165478358 | − | 0.5631965 |
| COBLL1 | 165510133 | 165700189 | − | 0.43199257 |
| SLC38A11 | 165752695 | 165812035 | − | 4.06730119 |
| SCN3A | 165944031 | 166060577 | − | 1.0807866 |
| SCN2A | 166095911 | 166248818 | + | 1.24475196 |
| CSRNP3 | 166326156 | 166545917 | + | 0.82971233 |
| GALNT3 | 166604100 | 166651192 | − | 0.33804418 |
| TTC21B | 166713984 | 166810353 | − | 1.58661143 |
| SCN1A | 166845669 | 166984523 | − | 62.9552975 |
| SCN9A | 167051694 | 167232503 | − | 1.71659087 |
| SCN7A | 167260082 | 167350757 | − | 0.29331967 |
| B3GALT1 | 168675181 | 168730551 | + | 0.64436013 |
| STK39 | 168810529 | 169104651 | − | 1.19821739 |
| CERS6 | 169312371 | 169631644 | + | 0.86828378 |
| NOSTRIN | 169643048 | 169722024 | + | 1.82142718 |
| SPC25 | 169690641 | 169769881 | − | 0.86880697 |
| ABCB11 | 169779447 | 169887832 | − | 3.1441368 |
| DHRS9 | 169921298 | 169952677 | + | 1.10381777 |
| BBS5 | 170335687 | 170382432 | + | 0.65476347 |
| KLHL41 | 170366211 | 170382772 | + | 0.87373377 |
| FASTKD1 | 170386258 | 170430385 | − | 1.02786927 |
| PPIG | 170440849 | 170497916 | + | 1.09866236 |
| CCDC173 | 170501934 | 170550943 | − | 0.67290779 |
| PHOSPHO2 | 170550974 | 170558218 | + | 0.91339152 |
| KLHL23 | 170550997 | 170633499 | + | 0.73926347 |
| SSB | 170648442 | 170668574 | + | 1.00631994 |
| METTL5 | 170666590 | 170681441 | − | 1.21271497 |
| UBR3 | 170683967 | 170940641 | + | 1.21350908 |
| MYO3B | 171034654 | 171511681 | + | 0.52839217 |

Example 9

Expression of SCN1A from an Expression Cassette In Vivo

To test the expression of transcriptional activators of SCN1A in vivo, recombinant AAV9 vectors were generated by Vector Biolabs (Malvern, PA). Male C57Bl/6 mice (N=5 per group, 7–8 weeks old) were infused bilaterally with 1.5 ul of purified AAV vector into the dorsal hippocampus (AP −2.0 mm, lateral ±1.5, DV −1.4 mm from dura) and ventral hippocampus (AP −3.1 mm, lateral ±2.8, DV −3.8 mm from dura), for a total of 4 injection sites. AAV was delivered at a rate of 0.3 ul/minute with a 4 m rest period following each injection. Four weeks after treatment, mice were euthanized and hippocampal tissue was dissected. For each group, tissue from both the left and right hippocampus tissue was collected pooled for homogenization in most animals (N=4), except for one animal, where only the left hippocampus was collected and homogenized. RNA was isolated from the homogenate (Qiagen RNeasy Mini kit), and DNase treated. RNA (3 μg) was reverse transcribed using OligoDT primers (Superscript IV, Invitrogen). cDNA samples were analyzed by qPCR for expression of mouse SCN1A using Phusion Polymerase (New England Biolabs) and SYBR Green I: 30 s at 98° C., 40× [10 sec at 98° C., 15 sec at 64° C., 15 sec at 72° C.]. Primers against mouse SCN1A (5'-CAAAAAAGCCACAAAAGCCT-3' (SEQ ID NO: 374); 5'-TTAGCTCCGCAAGAAACATC-3' (SEQ ID NO: 375)) were used to quantify levels of endogenous SCN1A transcript, and relative levels of SCN1A expression in vivo were determined by the delta-delta Ct method with GAPDH as a reference gene, using the same GAPDH primers as described in Example 1 above.

Figure 18A:
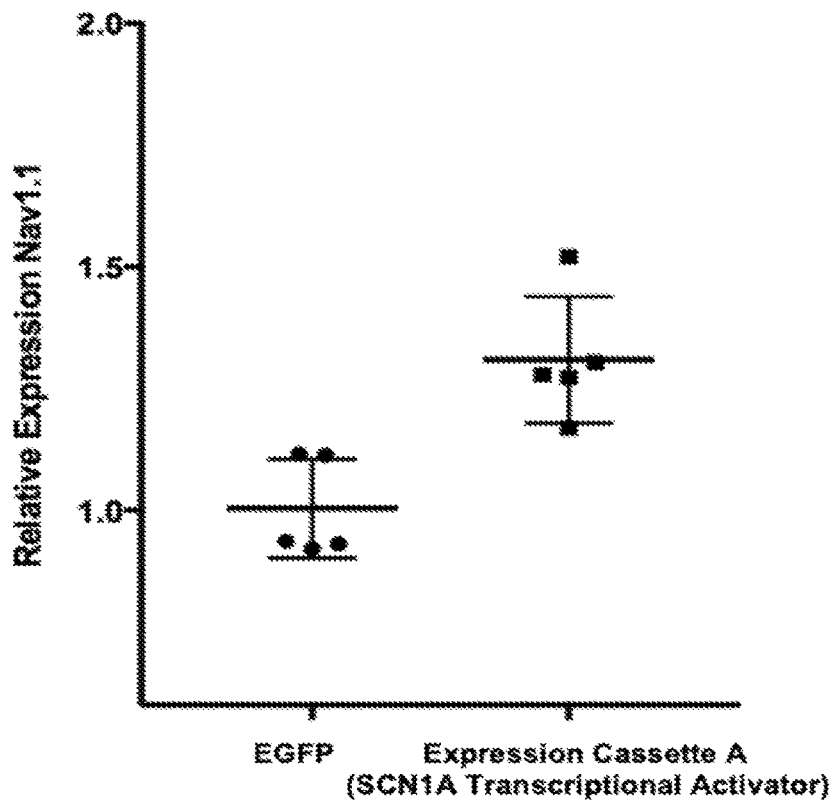
FIG. 18A and FIG. 18B illustrate expression of a SCN1A-specific transcriptional activator in vivo as compared to a control expression cassette which expressed eGFP.
Figure 18B:
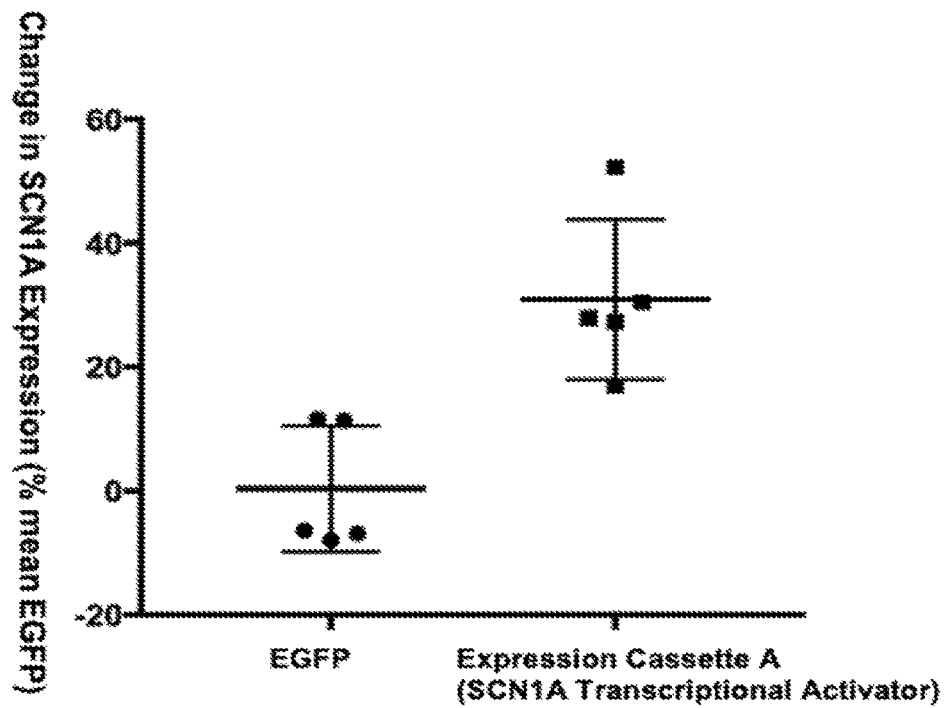

FIG. 18A and FIG. 18B illustrate the mean results of five animals, each injected with an AAV9 construct. The eGFP control construct comprised an eGFP reporter transgene. Expression cassette A (see TABLE 17) comprised a transcriptional activator that recognized a target sequence comprising SEQ ID NO: 35, as described in TABLE 17 above. FIG. 18A illustrates the relative expression of SCN1A in vivo. FIG. 18B illustrates the change in SCN1A expression in vivo as a percentage of mean eGFP expression. These results indicated the SCN1A transcriptional activator of expression cassette A resulted in approximately 20%-30% upregulation of SCN1A expression in vivo.

Such expression cassettes can be adapted for use in humans to treat Dravet syndrome, epilepsy, seizures, Alzheimer's disease, Parkinson's disease, and/or any other diseases or conditions associated with a deficiency and/or impaired activity of SCN1A.

Example 10

Figure 19A:
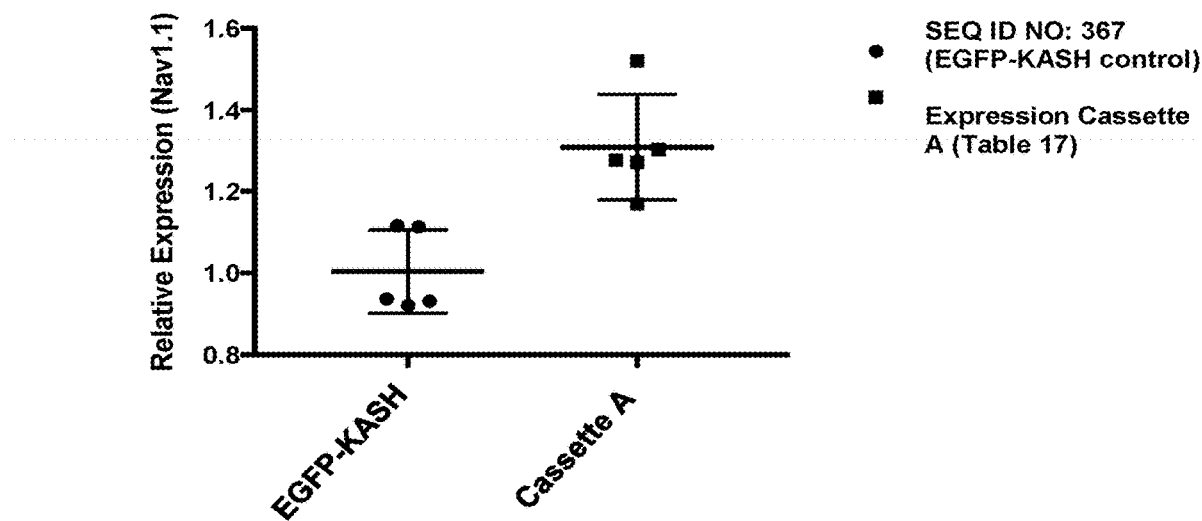
FIG. 19A, FIG. 19B, and FIG. 19C illustrate upregulation of endogenous SCN1A in the hippocampus of wild-type mice using several SCN1A specific transcription factors.
Figure 19B:
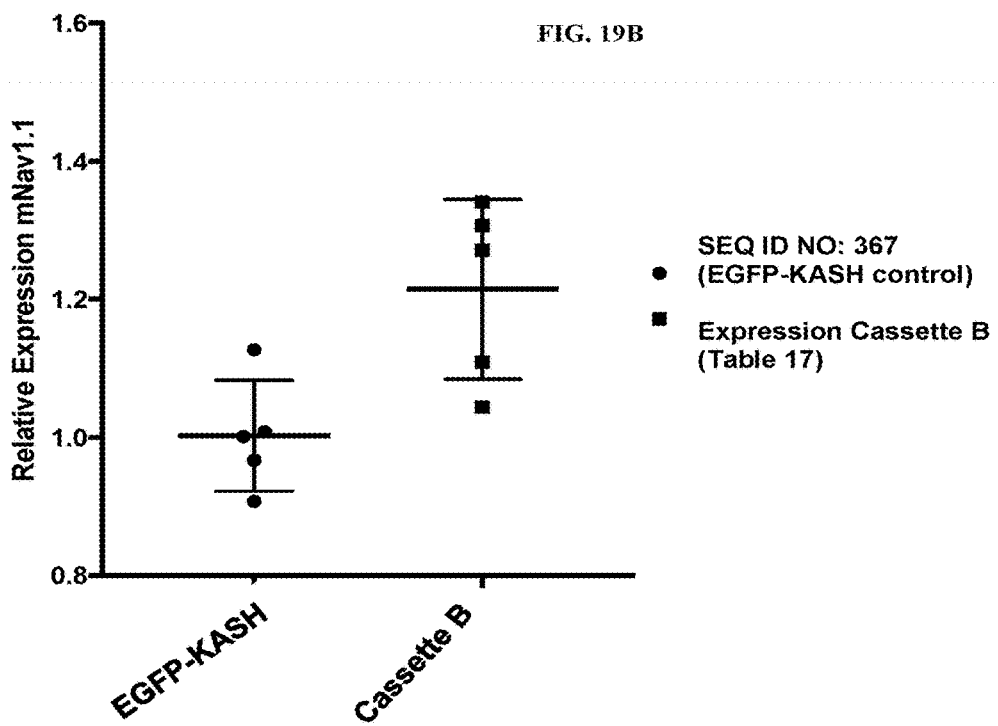
Figure 19C:
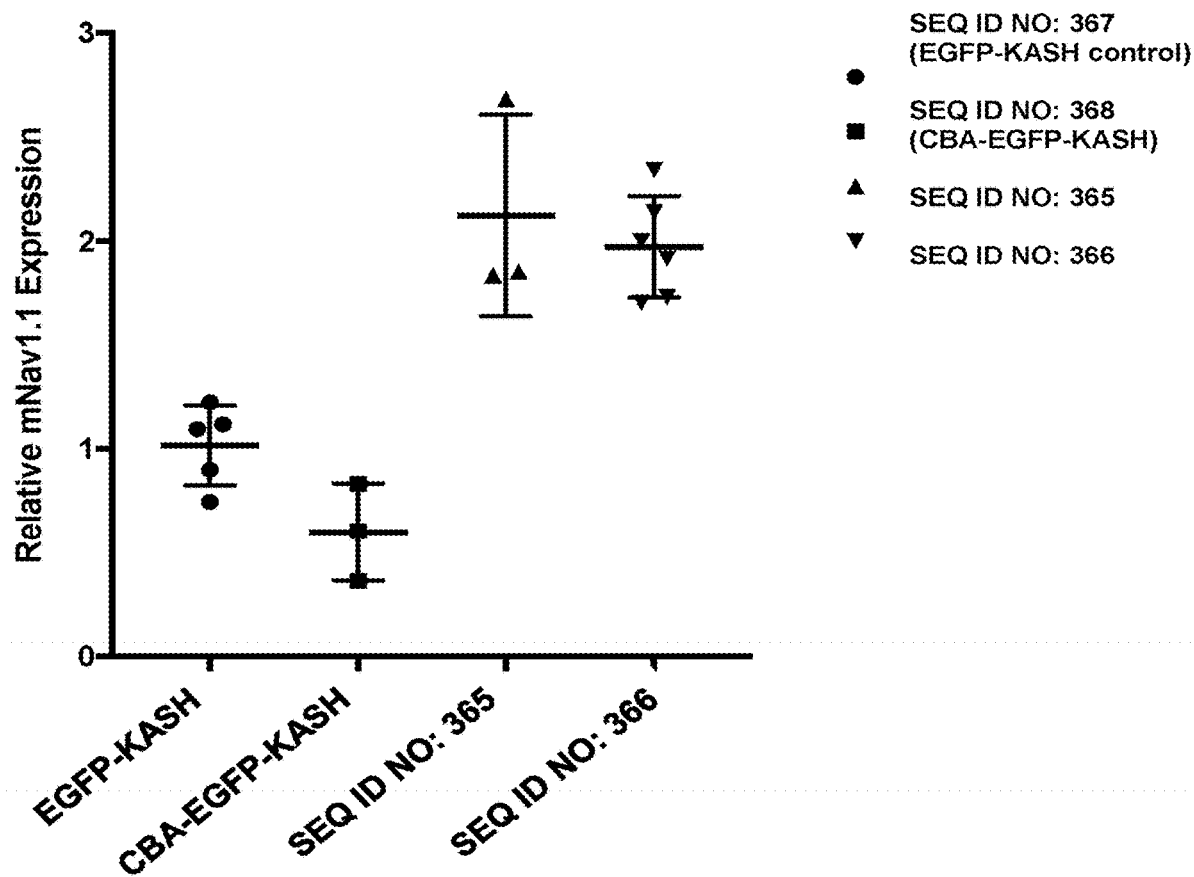
Figure 20A:
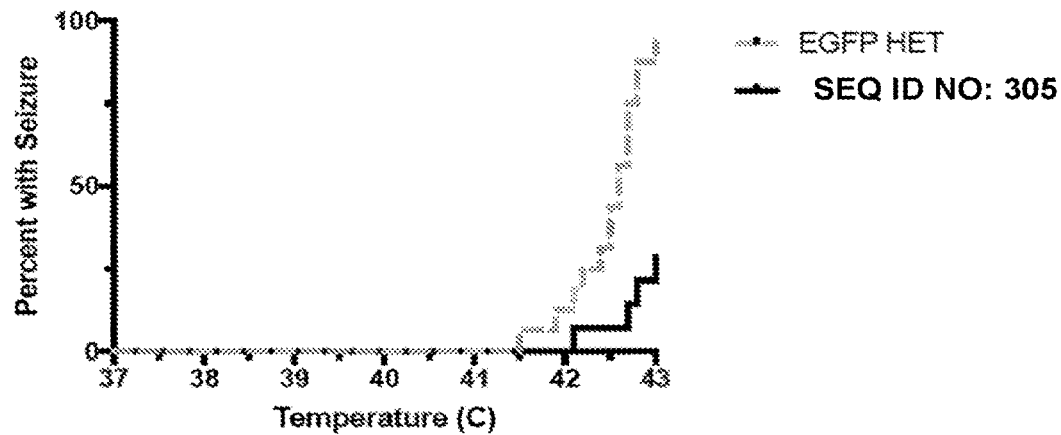
FIG. 20A, FIG. 20B, FIG. 20C, FIG. 20D, and FIG. 20E illustrate the effect on hyperthermic seizures in a mouse model of Dravet syndrome using various SCN1A specific transcription factors as compared to a control. P1 Scn1a +/− mice were infused with either AAV9-EGFP or an AAV9 vector expressing an SCN1A specific transcription factor (SEQ ID NOs: 305-309). At P26-P28 infused mice were run through the hyperthermia induced seizure assay and the internal temperature at which they experienced a tonic-clonic seizure was recorded.
Figure 20B:
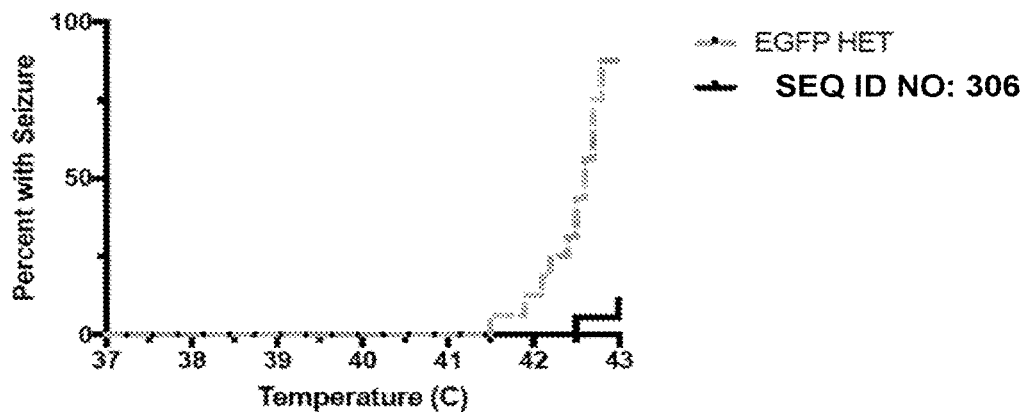
Figure 20C:
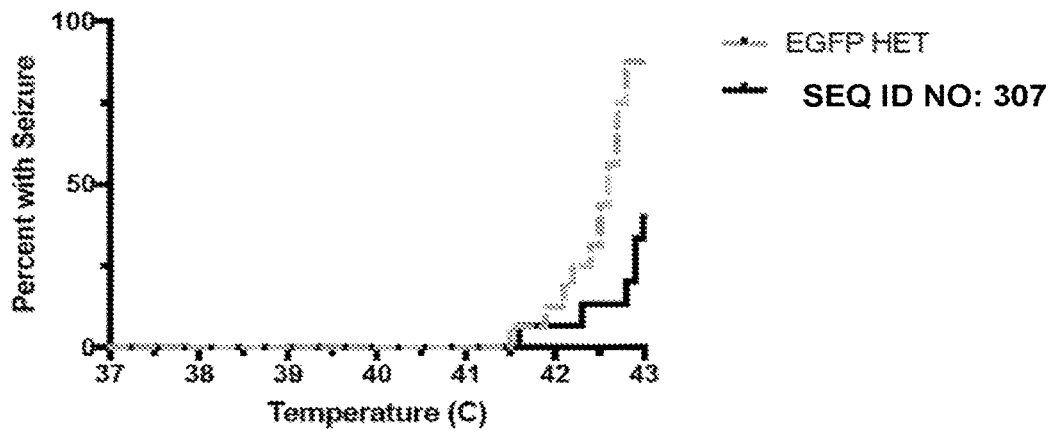
Figure 20D:
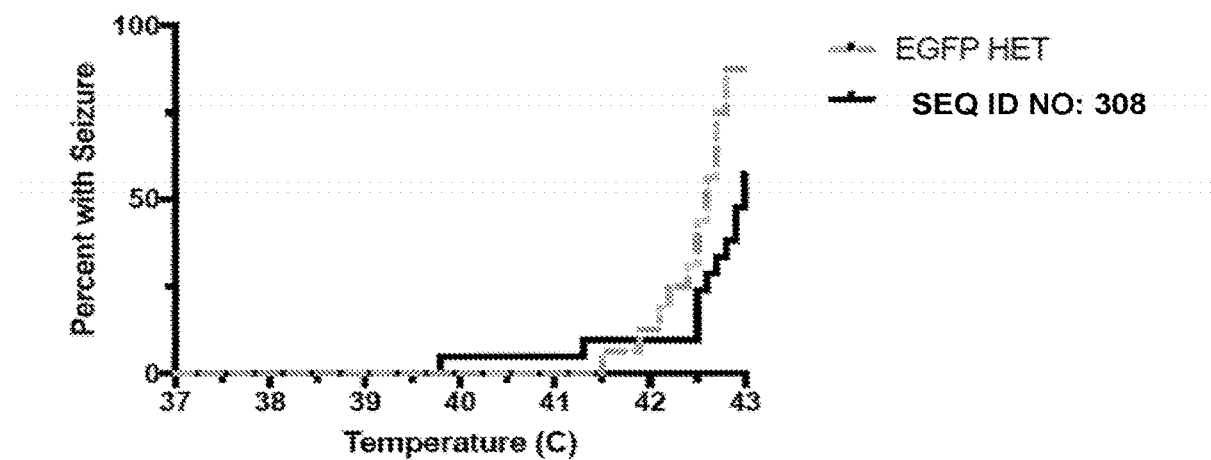
Figure 20E:
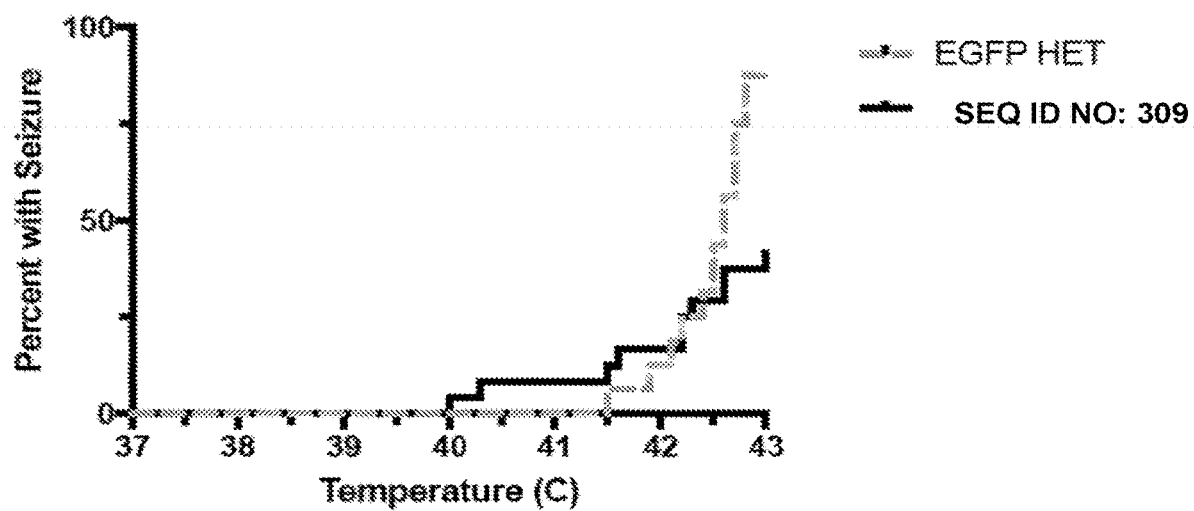
Figure 21A:
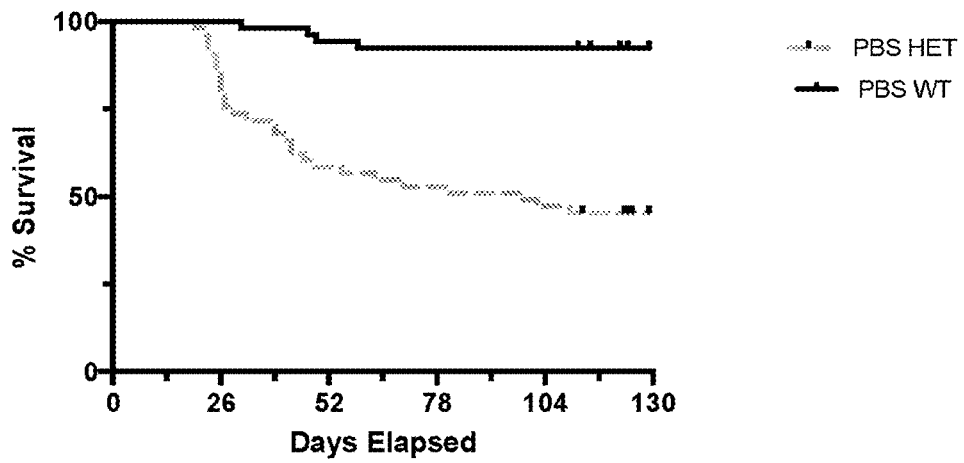
FIG. 21A, FIG. 21B, FIG. 21C, FIG. 21D, and FIG. 21E illustrate survival in a mouse model of Dravet syndrome under various conditions.
Figure 21B:
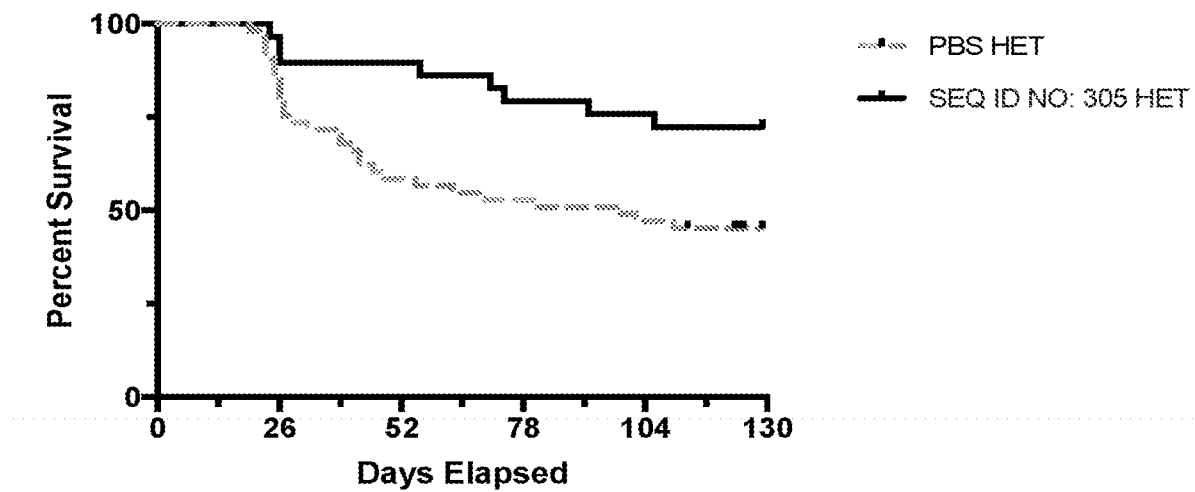
Figure 21C:
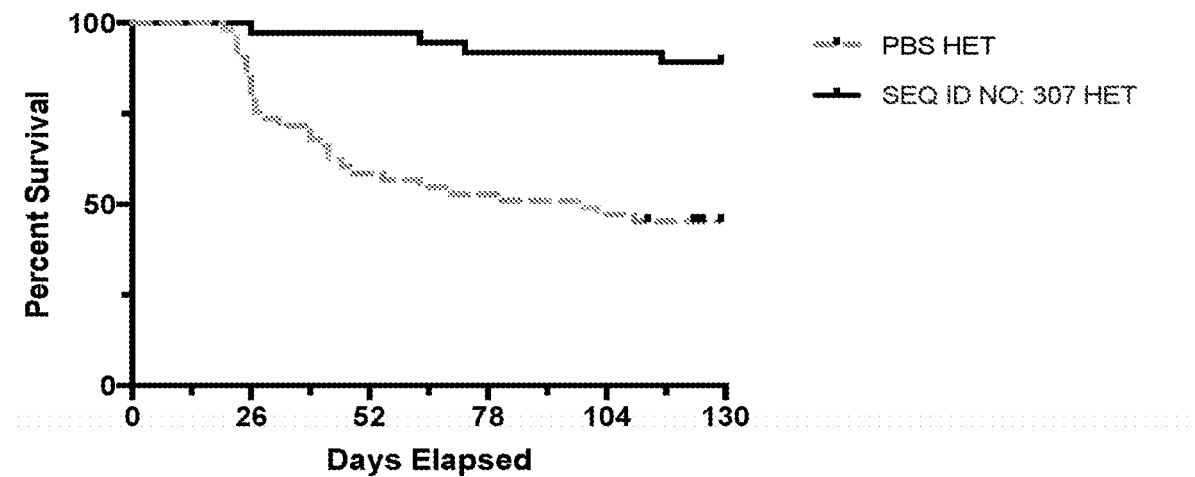
Figure 21D:
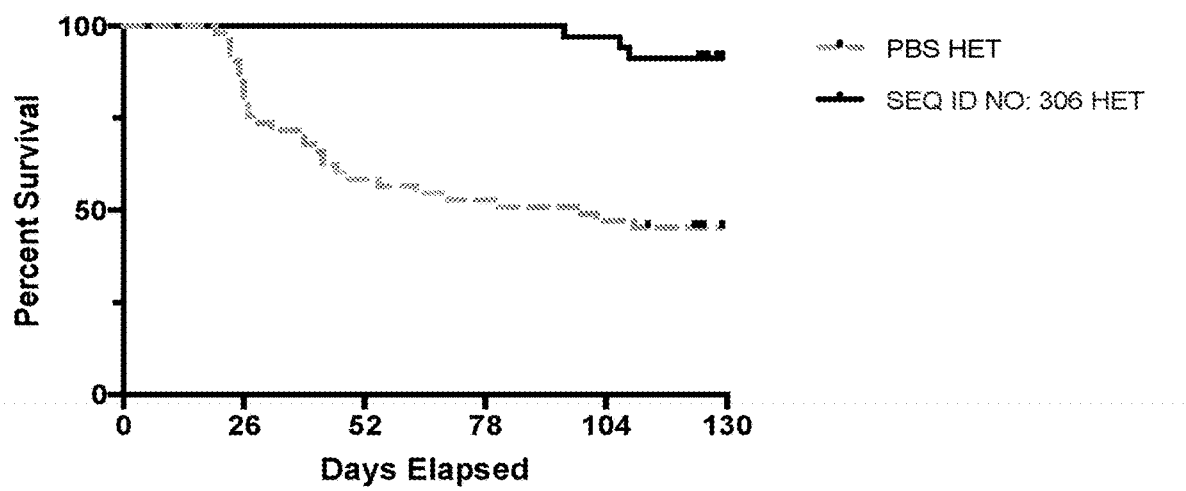
Figure 21E:
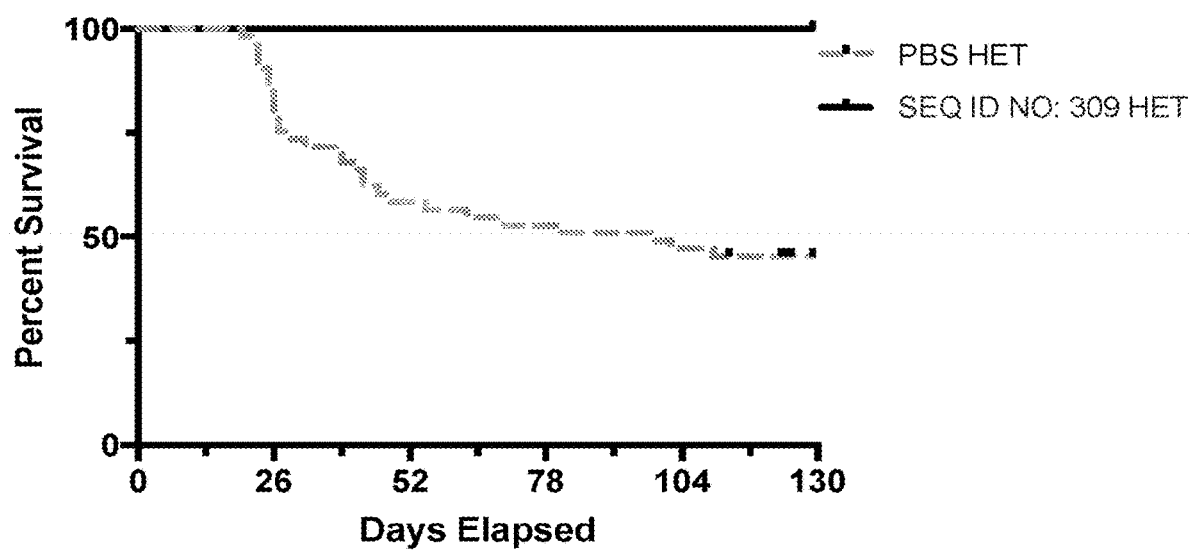

Upregulation of Endogenous SCN1A Transcript in WT Mouse Hippocampus Using SCN1A Specific Transcription Factor Determined by qPCR Recombinant AAV9 vector was generated by Vector Biolabs (Malvern, PA). Male C57Bl/6 mice (N=5 per group, 7-8 weeks old) were infused bilaterally with 1.5 ul of purified AAV vector into the dorsal hippocampus (AP −2.0 mm, lateral ±1.5, DV −1.4 mm from dura) and ventral hippocampus (AP −3.1 mm, lateral ±2.8, DV −3.8 mm from dura), for a total of 4 injection sites. AAV vectors containing various SCN1A specific transcription factors were used: Expression Cassette A in TABLE 17 (FIG. 19A), Expression Cassette B (FIG. 19B), and SEQ ID NO: 366 and SEQ ID NO: 365 (FIG. 19C) and compared to a control vector (EGFP-KASH driven by the same promoter) (FIG. 19A-C) and EGFP-KASH driven by a CBA promoter (FIG. 19C).

AAV was delivered at a rate of 0.3 ul/minute with a 4 minute rest period following each injection. Four weeks after treatment, mice were euthanized and hippocampal tissue was dissected. For each group, tissue from both the left and right hippocampus tissue was collected pooled for homogenization in most animals (N=4), except for one animal, where only the left hippocampus was collected and homogenized. RNA was isolated from the homogenate (Qiagen RNeasy Mini kit), and DNase treated. RNA (3 µg) was reverse transcribed using OligoDT primers (Superscript IV, Invitrogen). cDNA samples were analyzed by qPCR for mouse SCN1A (mNav1.1 forward primer: 5'-CAAAAAAGCCACAAAAGCCT-3' (SEQ ID NO: 293) and mNav1.1 reverse primer: 5'-TTAGCTCCGCAAGAAACATC-3' (SEQ ID NO: 294)) using Phusion Polymerase (New England Biolabs) and SYBR Green I: (30 s at 98° C., 40×[10 sec at 98° C., 15 sec at 64° C., 15 sec at 72° C.]).

Direct injection of AAV carrying each of the engineered transcription factor constructs resulted in upregulation of endogenous SCN1A transcript in mouse hippocampus tissue.

Example 11

Hyperthermic Seizure (HTS) Assay in Mouse Model of Dravet Syndrome

Treatment of Dravet syndrome and/or symptoms thereof using the expression cassettes was tested in the Scn1a$^{tm1kea}$ mouse line. This mouse line is an established mouse model for Dravet syndrome. Scn1a$^{tm1kea}$ mouse lines do not require CRE recombinase. The Scn1a$^{tm1kea}$ mouse (available from the Jackson Laboratory; described in Hawkins et al., Scientific Reports, vol. 7: 15327 (2017)) comprises a deletion of the first coding exon of SCN1A. Mice homozygous for the SCN1A knockout allele are characterized by tremors, ataxia, seizures, and die by postnatal day 16. Heterozygous mice on the C57BL/6 background develop spontaneous seizures and a large percentage die within weeks. Such a mouse strain can be used to study safety and efficacy of treatment of epilepsy and Dravet syndrome. See Miller et al., Genes Brain Behav. 2014 February; 13(2):163-72 for additional information.

To test the efficacy of transcriptional activators in the Scn1a$^{tm1kea}$ mouse line, litters of pups produced from male Scn1a +/− crossed with female C57Bl/6J breeding were dosed with AAV vector via bilateral ICV at P1. Mice were dosed with the constructs summarized in TABLE 36 below. Mice were left undisturbed with their dam until weening at P18 and then again left undisturbed until P26-P28 when the HTS assay was initiated. Separate litters of dosed P1 mice were weaned at P18 and observed for mortality daily. Hyperthermia seizure induction was performed in P26-P28 HET and WT Scn1a mice in a mixed 129Stac X C57BL/6 background. Prior to the assay mice had a lubricated rectal temperature probe (Ret-4) inserted and connected to a temperature control module (TCAT 2DF, Physitemp) that was connected in series with a heating lamp (HL-1). Mice were then placed into a large glass beaker and briefly allowed to equilibrate to the environment. Following this, body temperature was increased by ~0.5° C. every 2 minutes until the onset of the first tonic-clonic seizure accompanied by loss of posture or until 43° C. was reached. If a mouse experienced a seizure with loss of posture the experiment was ended and the internal body temperature of the mouse was recorded. If no seizure with loss of posture was detected over the full course of the experiment, that mouse was considered seizure free and the assay concluded. Tissue samples were obtained from the mice at P1 and genotyping of the mice was performed during the course of the experiment using real-time PCR. The genotyping was unblinded after the assay had been completed and the status of the mice as HET or WT was correlated to the data obtained. Data was plotted in a Kaplan-Meier survival curve and significance determined by the Mantel-Cox test. Results are shown in TABLE 36 and TABLE 37 and FIGS. 20A-E.

TABLE 36

Summary of conditions used in Example 11.

| SEQ ID NO of eTF | Dosage (gc/mouse) | Regulatory Element | Target Site recognized by eTF | DBD + TAD structure of eTF | PolyA |
| --- | --- | --- | --- | --- | --- |
| SEQ ID NO: 305 | 5.8E+10 | SEQ ID NO: 185 | SEQ ID NO: 35 | ZF DBD + VPR | sPA |
| SEQ ID NO: 306 | 6.0E+10 | SEQ ID NO: 185 | SEQ ID NO: 35 | ZF DBD + VP64 | hGH |
| SEQ ID NO: 307 | 1.4/1.7E+11 | SEQ ID NO: 417 | SEQ ID NO: 35 | ZF DBD + VP64 | sPA |
| SEQ ID NO: 308 | 3.1E+11 | SEQ ID NO: 185 | SEQ ID NO: 35 | ZF DBD + VP64 | hGH |
| SEQ ID NO: 309 | 4.3E+11 | SEQ ID NO: 183 | SEQ ID NO: 36 | ZF DBD + VPR | sPA |

TABLE 37

Summary of results of hyperthermic seizure assay.

| SEQ ID NO of eTF | # Control Animals (PBS treated) | # Treated Animals | % Seizure Free at 42.6° C. | P Value |
| --- | --- | --- | --- | --- |
| EGFP reporter | 16 | N/A | 44% | |
| SEQ ID NO: 305 | 16 | 14 | 93 | P < 0.001 |
| SEQ ID NO: 306 | 16 | 18 | 95 | P < 0.0001 |
| SEQ ID NO: 307 | 16 | 15 | 87 | P < 0.01 |
| SEQ ID NO: 308 | 16 | 21 | 76 | P < 0.05 |
| SEQ ID NO: 309 | 16 | 24 | 62.5 | P < 0.05 |

Example 12

Survival Assay in Mouse Model of Dravet Syndrome

To test the efficacy of transcriptional activators in the Scn1a$^{tm1kea}$ mouse line, litters of pups produced from male Scn1a +/− crossed with female C57Bl/6J breeding were dosed with AAV vector via bilateral ICV at P1. Mice were left undisturbed with their dam until weaning. Observation of the health status of Scn1a +/− mice was performed daily following weaning at P18. Mice that were found dead in their home cage of any cause had the date recorded. Data was plotted in a Kaplan-Meier survival curve and significance determined by the Mantel-Cox test.

Results are shown in TABLE 38 and FIGS. 21A-E.

TABLE 38

Summary of conditions and results for survival assay.

| SEQ ID | Dosage (gc/mouse) | # Control Animals (PBS treated) | # Treated Animals | % Survival at P100 (*at P83) | P Value |
|---|---|---|---|---|---|
| PBS | N/A | 53 | N/A | 49% | |
| SEQ ID NO: 305 | 5.8E+10 | 53 | 29 | 76% | P < 0.05 |
| SEQ ID NO: 306 | 6.0E+10 | 53 | 34 | 97% | P < 0.0001 |
| SEQ ID NO: 307 | 1.7E+11 | 53 | 37 | 92% | P < 0.0001 |
| SEQ ID NO: 309 | 4.3E+11 | 53 | 12 | 100% | P < 0.001 |

Example 13

SCN1A Transcription Levels in Non-Human Primates Following Treatment with AAV Encoding SCN1A Specific Transcription Factor The study used male cynomolgus macaques (*Macaca fascicularis*) between ages 2 and 3. Animals were pre-screened for cross-reactive antibody to AAV9 prior to enrollment in the study by a cell-based neutralizing antibody assay. AAV9 expressing an SCN1A specific transcription factor (SEQ ID NO: 305) or a control was diluted in PBS and injected intraparenchymally at 1.2E12 gc/animal. Three different stereotaxic coordinates in each hemisphere, six injection sites per animal, were identified for the injections. 10 ul volume was injected per site. Injections in the right hemisphere were symmetrical to those in the left. Two untreated animals were used as a control.

To assess Scn1A mRNA expression, reverse transcription followed by qPCR method was conducted. At necropsy, 28 days post dosing, tissues sections from various regions of the brain (frontal cortex, parietal cortex, temporal cortex, occipital cortex, hippocampus, medulla, cerebellum; 200 mg each) from control and treated animals were collected in RNAlater and then frozen. Briefly, 30 mg of tissue was dissected, RNA extracted (with Qiagen Rneasy Lipid tissue mini kit, catalog #1023539), converted to cDNA by reverse transcription (using Applied Biosystems high capacity cDNA Reverse Transcription kit, catalog #4368814) and qPCR performed using primer/probe set for Scn1A and housekeeping gene GAPDH (Applied Biosystems, catalog #Rh02621745-gI FAM). Primer/probe sets for SCN1A are given below.

Primer/probe sets for SCN1A are given below. Gene expression of Scn1A in each test sample was determined by relative quantitation (RQ) using the comparative Ct ($\Delta Ct$) method. This method measures Ct difference ($\Delta Ct$) between target gene and housekeeping gene, then compares $\Delta Ct$ values of treatment samples to control samples.

Figure 22:
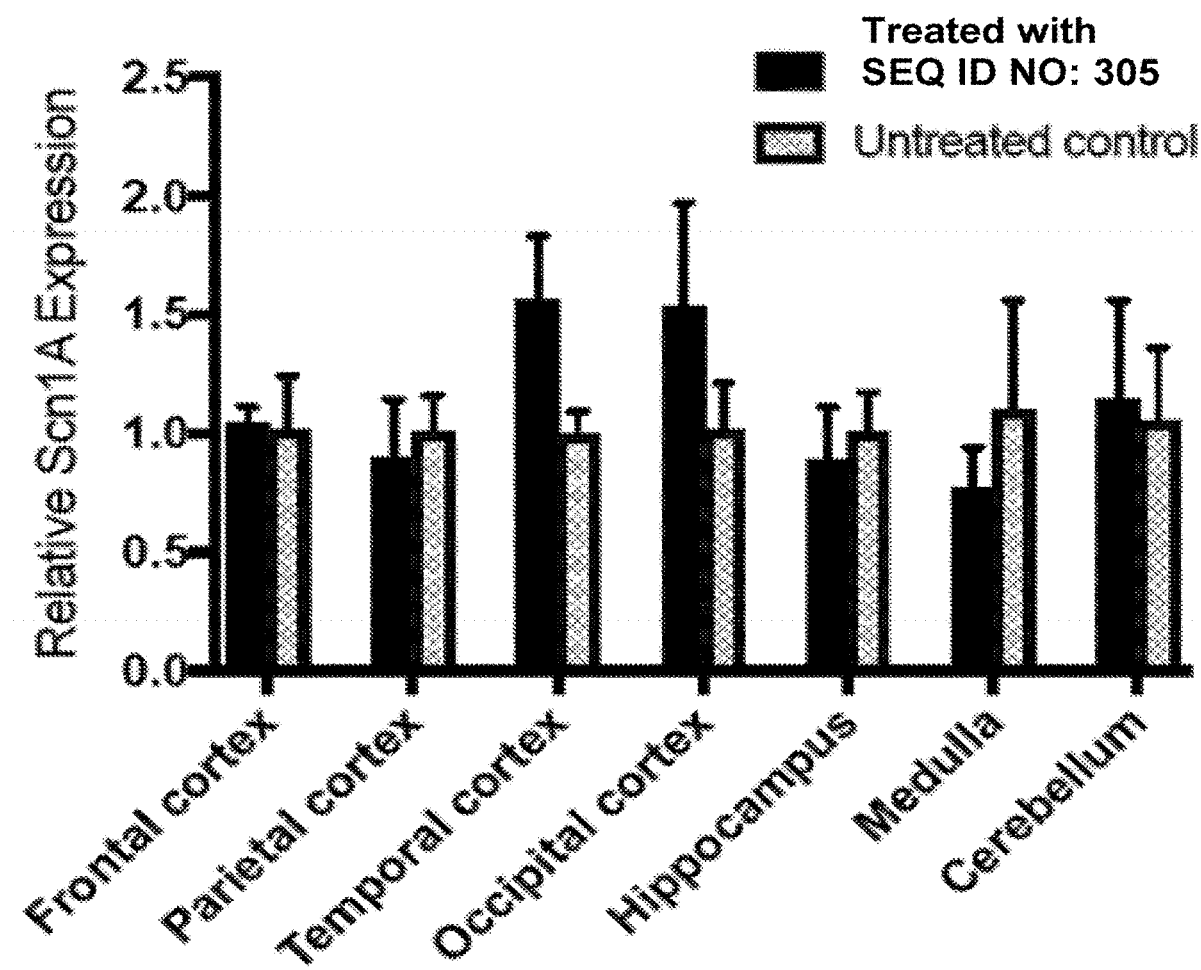
FIG. 22 illustrates relative Scn1A mRNA expression in different brain tissues following intraparenchymal delivery of an AAV9 vector encoding an SCN1A specific transcription factor (SEQ ID NO: 305), administered to two cynomolgus macaques at $1.2 \times 10^{12}$ gc/animal, normalized to two untreated control animal. All animals were sacrificed 28 days after injection and Scn1A mRNA was quantified in the tissue samples by Taqman PCR. Data is reported as normalized expression of target mRNA in different tissue sections from the brain. Similar results were recorded with a different set of Scn1a gene derived primers/probe as well.

$\Delta Ct$=Ct average of Target gene–Ct average of housekeeping gene $\Delta\Delta Ct$=$\Delta Ct$ of treatment sample–$\Delta Ct$ control sample Relative expression (treatment sample)=$2^{-\Delta\Delta Ct}$ Data is reported as normalized expression of target mRNA in different tissue sections from the brain (see FIG. 22). As illustrated in FIG. 22, sites in the brain proximal to the intraparenchymal injection sites showed the highest levels of SCN1A transcript expression.

Example 14

Treatment of Dravet Syndrome in Different Mouse Lines

Treatment of Dravet syndrome and/or symptoms thereof using the expression cassettes described herein can be tested in various mouse lines, such as B6(Cg)-Scn1a$^{tm1.1Dsf}$/J, Scn1a$^{tm1kea}$, and Scn1a-R1470X mouse lines. These mouse lines are established mouse models for Dravet syndrome. Scn1a$^{tm1kea}$ and Scn1a-R1470X mouse lines do not require CRE recombinase.

B6(Cg)-Scn1a$^{tm1.1Dsf}$/J mice can be obtained from the Dravet Syndrome European Federation via the Jackson Laboratories to study the safety and efficacy of the SCN1A transcriptional activator compositions described herein in treating Dravet syndrome. These mice contain a Dravet syndrome associated mutation in exon 24 of SCN1A (A to V at position 1783). The mice also contain a foxed exon 24 with wildtype sequence. When not manipulated, this strain of mice expresses two copies of the WT allele of SCN1A. However, upon delivery of an AAV expressing Cre recombinase or crossing this strain with a Cre expressing mouse line, any cell expressing Cre will switch to expressing one copy of the mutant allele. Upon expression of the mutant

TABLE 39

Primer Sequences used in Example 13

| Gene | SEQ ID NO | Sequence (5'-3') | Note |
|---|---|---|---|
| Scn1A | SEQ ID NO: 328 | CCATGGAACTGGCTCGATTTCAC | F-primer |
| | SEQ ID NO: 439 | ATTGGTGGGAGGCCACTGTAT | R-primer |
| | SEQ ID NO: 329 | AGGCCTGAAAACCATTGTGGGAGCCCT | Probe (FAM) |

SCN1A subunit, mice develop spontaneous seizures within 4 weeks. For the B6(Cg)-Scn1a$^{tm1.1Dsf}$/J mouse experiments, B6(Cg)-Scn1a$^{tm1.1Dsf}$/J mice and control C57Bl6 mice can be used.

The Scn1a$^{tm1kea}$ mouse (available from the Jackson Laboratory; described in Hawkins et al., Scientific Reports, vol. 7: 15327 (2017)) comprises a deletion of the first coding exon of SCN1A. Mice homozygous for the SCN1A knockout allele are characterized by tremors, ataxia, seizures, and die by postnatal day 16. Heterozygous mice on the C57BL/6 background develop spontaneous seizures and die within weeks. Such mouse strain can be used to study safety and efficacy of treatment of epilepsy and Dravet syndrome. See Miller et al., Genes Brain Behav. 2014 February; 13(2):163-72 for additional information.

The Scn1a-R1470X mouse is a knock-in mouse carrying a premature stop codon, R1407X, in exon 21 of the SCN1A gene. The same mutation has been identified as a pathogenic mutation in three unrelated SMEI patients. Scn1a$^{RX/RX}$ pups are characterized by recurrent spontaneous seizures at 12 postnatal days, including tonic-clonic and clonic seizures at 12-16 postnatal days, and rhythmic jerking movements and involuntary muscle contraction. See Ogiwara et al., Journal of Neuroscience, May 30, 2007, 27 (22) 5903-5914 for additional information.

To test the compositions described herein, including AAV gene therapy and treatment using such gene therapy, comprising an eTF that upregulates SCN1A expression in vivo, Dravet mice of each of the mouse strains described above and control mice (e.g., mouse with a wild-type SCN1A or an untreated Dravet mouse for the strain) are injected (e.g., administered by intraperitoneal injection) with AAVs expressing either EGFP or another reporter gene, or an expression cassette comprising an eTF that binds to a target binding sequence proximal to endogenous SCN1A (e.g., any of the expression cassettes disclosed herein). Some AAVs can further comprise one or more cell type-selective regulatory elements.

Following AAV injections, mouse survival is monitored over time. All mice are monitored daily for general health (e.g. weight, hydration, grooming, and mobility) and deaths are recorded.

Telemetry implantation can be performed immediately after AAV injections (F20-EET, Data Sciences International). Electrocorticogram data can be recorded and monitored continuously for at least 14 days from 10 days after the surgery. All seizure events can be recorded for at least 14 days following AAV treatment, annotated with date, time start, time stop, duration, and severity score. A reduction in the frequency and/or duration of seizures following treatment with an AAV comprising a SCN1A transcriptional activator as compared to the EGFP control or an untreated control is indicative of the efficacy of the SCN1A transcriptional activator in reducing the symptoms and/or severity of Dravet syndrome.

After treatment of the mice with AAV, the expression levels of SCN1A can be monitored over time using various PCR and/or sequencing methods to show AAV treatment with a SCN1A transcriptional activator can result in an increase in endogenous SCN1A expression. Northern blot analysis and in situ hybridization can also be used to analyze SCN1A expression in vivo. The level of Nav1.1 protein can also be monitored after treatment to show an increase in SCN1A expression correlates with an increase in Nav1.1 protein. Nav1.1 protein can be assayed using various methods, including, but not limited to, Western blot analysis, immunohistochemistry, immunofluorescence histochemistry, and/or ELISA assays. Formation of functional voltage-gated sodium ion channels can also be assayed using current-clamp analysis.

Hyperthermia-induced seizures can be evaluated to compare the wild-type mice and/or untreated Dravet mice with Dravet mice treated with AAV gene therapy comprising an expression cassette described herein. In such experiments, the core body temperature is monitored with a RET-3 rectal temperature probe (Physitemp Instruments, Inc., New Jersey, USA) and controlled by a heat lamp connected to a rodent temperature regulator (TCAT-2DF, Physitemp) reconfigured with a Partlow 1160+controller (West Control Solutions, Brighton, UK). Body temperature is raised 0.5° C. every two minutes until the onset of the first clonic convulsion. Dravet mice treated with an AAV comprising a SCN1A transcriptional activator is expected to have a higher threshold temperature before the onset of first clonic convulsion as compared to the untreated Dravet mice.

Different doses of AAV comprising an expression cassette can also be administered to mice to determine the safety and efficacy profile of each gene therapy treatment. These preclinical studies can also inform the optimal dose(s) of the gene therapy to use for treating Dravet syndrome.

Example 15

Treatment of Alzheimer's Disease in Mouse

Female APP/PS1 and wild-type (WT) mice, which are bred at PsychoGenics and are established mouse model of Alzheimer's disease, can be used to study the safety and efficacy of the SCN1A transcriptional activator compositions described herein in treating Alzheimer's disease. APP/PS1 mice contain human transgenes for both Amyloid Beta Precursor Protein (APP) bearing the Swedish mutation (670 G-T and 671 A-C) and Presenilin 1 (PSEN1) containing an L166P mutation, both under the control of the Thy1 promoter. These mice develop symptoms of Alzheimer's disease, including amyloid plaques and memory defects. Further description of these mice can be found in Radde et al, 2006 (Radde, Rebecca, et al. "Aβ42-driven cerebral amyloidosis in transgenic mice reveals early and robust pathology." EMBO reports 7.9 (2006): 940-946).

APP/PS1 mice and non-transgenic controls are injected with either a control AAV vector expressing EGFP or a treatment AAV vector comprising a SCN1A transcriptional activator (e.g., any of the expression cassettes disclosed herein). Some AAVs can further comprise a GABAergic-selective and/or a PV-selective regulatory element.

Following AAV injections, mouse survival is monitored over time. All mice are monitored daily for general health (e.g. weight, hydration, grooming, and mobility) and deaths are recorded. After injections of the AAVs, mice are also implanted with an EET transmitter. Brain activity can be recorded and monitored over 24 hours for at least 4 weeks after surgery. Electrocorticogram data can be automatically analyzed, and power levels in the different frequency bands (50-100 Hz) can be compared across different groups: WT mice, untreated APP/PS1 mice, and AAV-treated APP/PS1 mice, each treated with an AAV gene therapy as described above. Increased high gamma power activity is associated with seizures in Alzheimer's patients and epilepsy patients. Thus, the untreated APP/PS1 mice are expected to show a higher level of high gamma power activity than the control mice, while this increase is expected to be absent or reduced in the treated mice, indicating an effective treatment with an AAV gene therapy comprising a transcriptional activator of SCN1A.

After treatment of the mice with AAVs, the expression levels of SCN1A can be monitored over time using various PCR and/or sequencing methods to show AAV treatment with a SCN1A transcriptional activator can result in an increase in endogenous SCN1A expression. Northern blot analysis and in situ hybridization can also be used to analyze SCN1A expression in vivo. The level of Nav1.1 protein can also be monitored after treatment to show an increase in SCN1A expression correlates with an increase in Nav1.1 protein. Nav1.1 protein can be assayed using various methods, including, but not limited to, Western blot analysis, immunohistochemistry, immunofluorescence histochemistry, and/or ELISA assays. Formation of functional voltage-gated sodium ion channels can also be assayed using current-clamp analysis.

Different doses of AAV comprising an expression cassette can also be administered to mice to determine the safety and efficacy profile of each gene therapy treatment. These preclinical studies can also inform the optimal dose(s) of the gene therapy to use for treating Alzheimer's disease.

Example 16

Identification of Target Regions Capable of Upregulating GRN Using GRN Specific Transcriptional Activator In order to identify regions of the genome capable of upregulating endogenous GRN expression, various engineered transcription factors (either zinc finger nucleases or gRNA/daCas9 constructs) were designed that targeted various regions of the genome as set forth in TABLE 40 below. For gRNA/daCas9 constructs, the gRNA had the same sequence as the target region because the gRNA was designed to target the complementary genomic strand. HEK293 cells were cultured per standard methods, and transfected (FugeneHD, Promega) with 3 ug plasmid carrying an engineered transcription factor or control construct per well of a 6-well plate. Cells were transfected with plasmids expressing the constructs shown below in TABLE 40 and TABLE 41. 48 h following transfection, cells were collected and RNA was isolated (Qiagen RNeasy Mini kit), and DNase treated. RNA (3 ug) was reverse transcribed using OligoDT primers (Superscript IV, Invitrogen). cDNA samples were analyzed by qPCR using Phusion Polymerase (New England Biolabs) and SYBR Green I: (30 s at 98° C., 40×[10 sec at 98° C., 15 sec at 66° C., 15 sec at 72° C.]). Primers against SCN1A (5'-TGTCTCGGCATTGAGAA-CATTC-3' (SEQ ID NO: 190; 5'-ATTGGTGGGAGGCCAT-TGTAT-3' (SEQ ID NO: 191)) were used to quantify levels of endogenous SCN1A transcript, and relative levels of SCN1A expression were determined by the delta-delta Ct method with GAPDH as a reference gene (5'-AC-CACAGTCCATGCCATCAC'3' (SEQ ID NO: 192); 5'-TC-CACCACCCTGTTGCTGTA-3' (SEQ ID NO: 193)). Data are presented as fold changes relative to the control condition.

Figure 23:
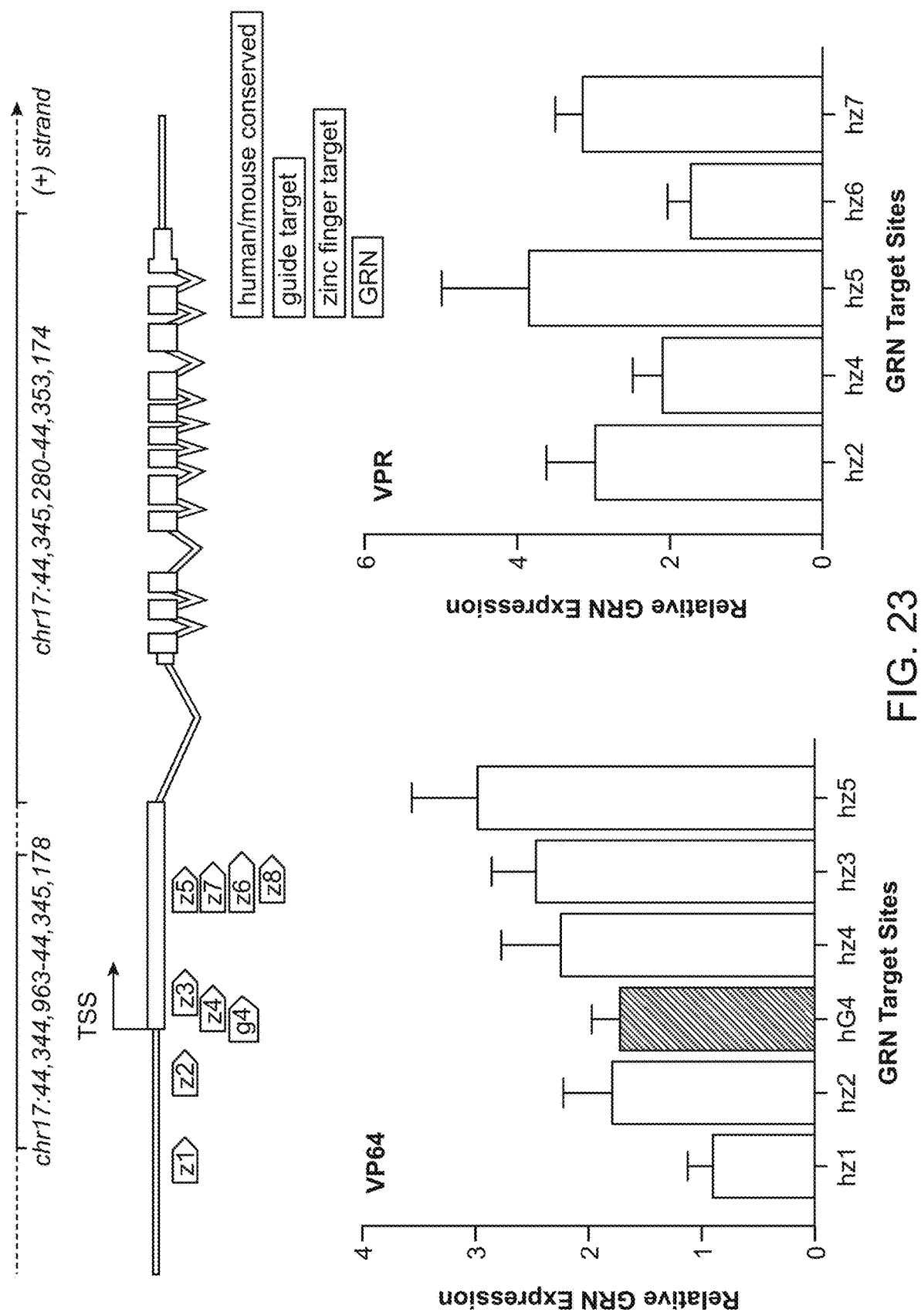
FIG. 23 illustrates upregulation of endogenous GRN using engineered transcription factors that bind to various genomic regions.

The results are shown in FIG. 23 and in TABLE 40 below as fold change of GRN transcription relative to control conditions (e.g., EGFP-KASH control).

TABLE 40

GRN target regions and effect on upregulation of endogenous GRN using the specified transcription factors.

| eTF SEQ ID NO: | eTF sequence | Target site SEQ ID NO: |
|---|---|---|
| SEQ ID NO: 337 | (see above) | SEQ ID NO: 330 |
| A | (see TABLE 23) | SEQ ID NO: 331 |

TABLE 40-continued

GRN target regions and effect on upregulation of endogenous GRN using the specified transcription factors.

| eTF SEQ ID NO: | eTF sequence | Target site SEQ ID NO: |
|---|---|---|
| C | (see TABLE 23) | SEQ ID NO: 332 |
| M | (see TABLE 23) | SEQ ID NO: 113 |
| D | (see TABLE 23) | SEQ ID NO: 333 |
| E | (see TABLE 23) | EQ ID NO: 333 |
| F | (see TABLE 23) | SEQ ID NO: 38 |
| J | (see TABLE 23) | SEQ ID NO: 38 |
| G | (see TABLE 23) | SEQ ID NO: 38 |
| B | (see TABLE 23) | SEQ ID NO: 331 |
| SEQ ID NO: 338 | (see above) | SEQ ID NO: 331 |
| H | (see TABLE 23) | SEQ ID NO: 334 |
| I | (see TABLE 23) | SEQ ID NO: 335 |
| SEQ ID NO: 339 | (see above) | SEQ ID No: 336 |
| SEQ ID NO: 340 | (see above) | SEQ ID NO: 38 |
| SEQ ID NO: 341 | (see above) | SEQ ID NO: 38 |
| K | (see TABLE 23) | SEQ ID NO: 38 |
| L | (see TABLE 23) | SEQ ID NO: 38 |
| SEQ ID NO: 342 | (see above) | SEQ ID NO: 38 |
| SEQ ID NO: 343 | (see above) | SEQ ID NO: 38 |
| SEQ ID NO: 344 | (see above) | SEQ ID NO: 335 |
| SEQ ID NO: 10 | (see above) | SEQ ID NO: 38 |
| SEQ ID NO: 16 | (see above) | SEQ ID NO: 38 |
| SEQ ID NO: 46 | (see above) | SEQ ID NO: 38 |
| SEQ ID NO: 345 | (see above) | SEQ ID NO: 38 |
| SEQ ID NO: 60 | (see above) | SEQ ID NO: 38 |
| SEQ ID NO: 346 | (see above) | SEQ ID NO: 38 |
| SEQ ID NO: 63 | (see above) | SEQ ID NO: 38 |
| SEQ ID NO: 64 | (see above) | SEQ ID NO: 38 |
| SEQ ID NO: 347 | (see above) | SEQ ID NO: 38 |
| SEQ ID NO: 348 | (see above) | SEQ ID NO: 38 |
| SEQ ID NO: 349 | (see above) | SEQ ID NO: 38 |
| SEQ ID NO: 350 | (see above) | SEQ ID NO: 38 |

TABLE 41

GRN DBDs

| eTF SEQ ID NO: | DBD SEQ ID NO: |
|---|---|
| SEQ ID NO: 337 | SEQ ID NO: 377 |
| SEQ ID NO: 338 | SEQ ID NO: 378 |
| SEQ ID NO: 339 | SEQ ID NO: 379 |
| SEQ ID NO: 340 | SEQ ID NO: 380 |
| SEQ ID NO: 341 | SEQ ID NO: 381 |
| SEQ ID NO: 342 | SEQ ID NO: 382 |
| SEQ ID NO: 343 | SEQ ID NO: 383 |
| SEQ ID NO: 344 | SEQ ID NO: 384 |
| SEQ ID NO: 345 | SEQ ID NO: 385 |
| SEQ ID NO: 346 | SEQ ID NO: 386 |
| SEQ ID NO: 347 | SEQ ID NO: 387 |
| SEQ ID NO: 348 | SEQ ID NO: 388 |
| SEQ ID NO: 349 | SEQ ID NO: 389 |
| SEQ ID NO: 350 | SEQ ID NO: 390 |

Example 17

Relative Expression of GRN From an Expression Cassette

This example describes relative expression of GRN from an expression cassette comprising a non-naturally occurring transcriptional activator which increased the expression of the GRN gene (as measured by GRN RNA) in HEK293 cells. Expression cassettes A, B, C, D, E, F, J, K, L, G, H, I, and M were constructed, each comprising a non-naturally occurring transcriptional modulator that comprises a DNA binding domain, selected from SEQ ID NOs: 165-170 and SEQ ID NO: 112, linked to a VPR or VP64 transcriptional activation domain (e.g., SEQ ID NO: 95 or SEQ ID NO: 114), as described in TABLE 23 above. Each expression cassette also comprised a regulatory element having a sequence of SEQ ID NO: 178 or 179. Expression cassette J is similar to expression cassette K except J further comprised an eGFP reporter.

To test the GRN transcriptional activators, HEK293 cells were cultured per standard methods, and transfected (PEI) with 3 µg plasmid per well of a 6-well plate. 48 h following transfection, cells were collected and RNA was isolated (Qiagen RNeasy Mini kit), and DNase treated. RNA (3 µg) was reverse transcribed using OligoDT primers (Superscript IV, Invitrogen). cDNA samples were analyzed by qPCR using Phusion Polymerase (New England Biolabs) and SYBR Green I: (30 s at 98° C., 40×[10 sec at 98° C., 15 sec at 66° C., 15 sec at 72° C.]). Primers against GRN (5'-ATGGTCAGTTCTGCCCTGTG-3' (SEQ ID NO: 287); 5'-CGGTAAAGATGCAGGAGTGGC-3'(SEQ ID NO: 288)) were used to quantify levels of endogenous GRN transcript, and relative levels of GRN expression were determined by the delta-delta Ct method with GAPDH as a reference gene (5'-ACCACAGTCCATGCCATCAC-3' (SEQ ID NO: 192); 5'-TCCACCACCCTGTTGCTGTA-3' (SEQ ID NO: 193)).

Figure 24A:
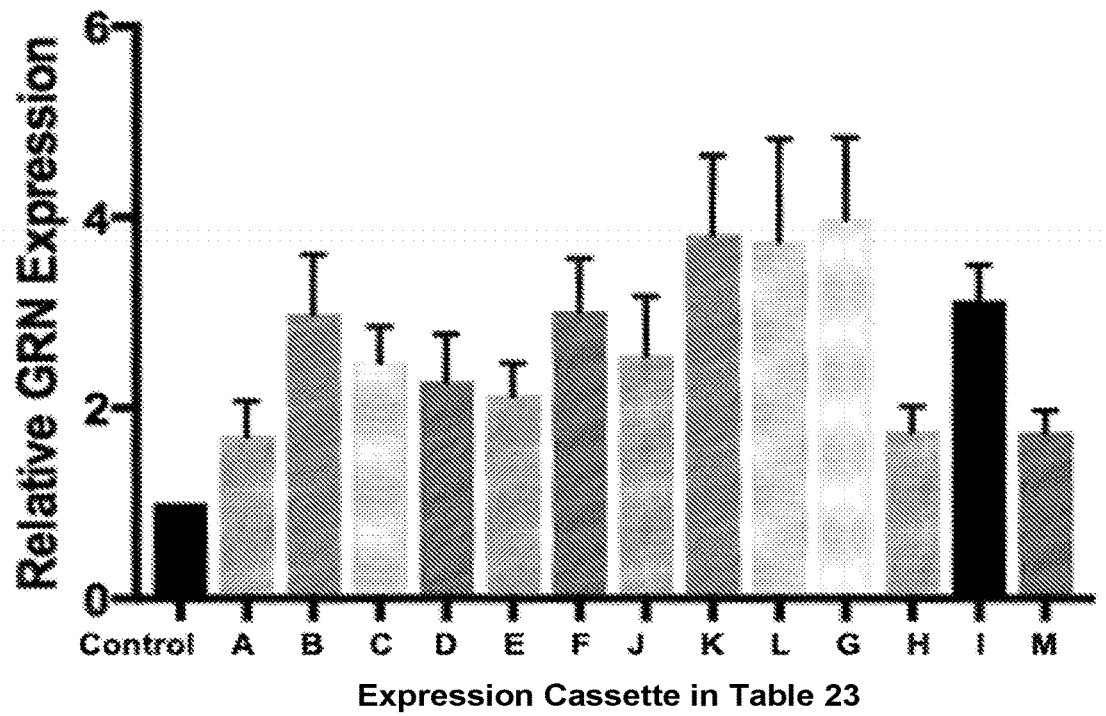
FIG. 24A and FIG. 24B illustrate the in vitro experiments with various expression cassettes, each comprising a transcriptional activator of GRN.

The control refers to an expression cassette comprising SEQ ID NO: XX and lacking a transcriptional activator. FIG. 24A illustrates the relative expression of GRN in HEK293 cells transfected with each expression cassette, presented as fold changes relative to the control condition. This experiment showed transcriptional activators as described herein resulted in upregulation of RNA transcribed from the endogenous GRN gene. All the transcriptional activator expression cassettes tested resulted in an increase in GRN expression in HEK293 cells.

Figure 24B:
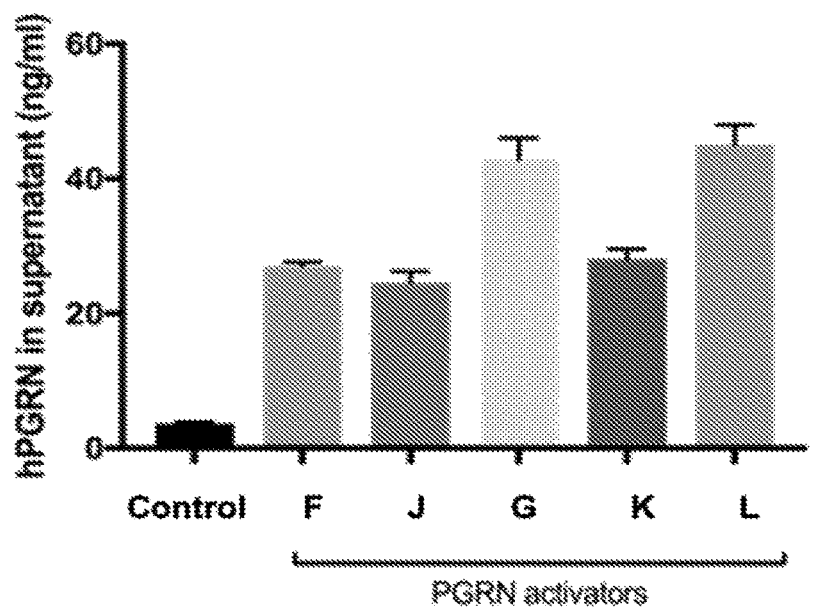

ELISA experiments were also performed to evaluate the ability of the expression cassettes comprising various transcriptional activators of GRN to increase secreted progranulin (hPGRN) protein in a cell. 293T cells were transfected with certain expression cassettes described in TABLE 23, and culture media was collected 48 hours after transfection. After a brief spin to remove cell debris, culture media was subjected to ELISA analysis using a human progranulin ELISA kit from R&D Systems according to the manufacturer's instructions. Concentrations of progranulin were calculated based on the standard curve analysis described in the kit manual. FIG. 24B illustrates the average of three independent ELISA results obtained for each expression cassette tested in terms of human progranulin (hPGRN) in supernatant (ng/mL). All the transcriptional activator expression cassettes tested resulted in an increase in secreted hPRGN in cells relative to the control expression cassette.

Example 18

Increasing Gene Expression in HEK293T Cells

Figure 25:
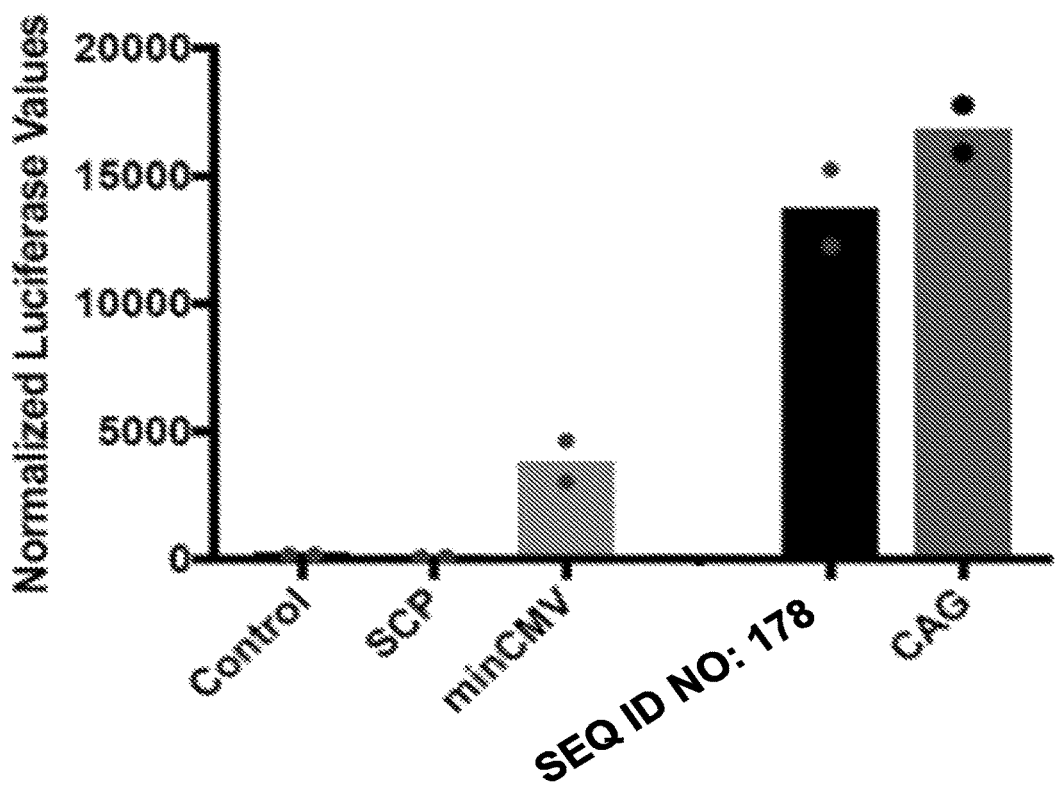
FIG. 25 illustrates the normalized luciferase activity of various regulatory elements (REs) on the expression of luciferase in 293T cells. For example, regulatory element SEQ ID NO: 178 operably linked to a minCMV promoter drove expression of luciferase at a level about 3.5 fold higher than the minCMV promoter alone and about 140 fold higher than a SCP promoter.

HEK293T cells were transfected with plasmid DNA containing a luciferase gene under the control of one of several different regulatory elements, i.e., no promoter control, SCP, CMV, SEQ ID NO: 178 operably linked to minCMV, and CAG. The normalized luciferase values from each construct are illustrated in FIG. 25. Regulatory element SEQ ID NO: XX operably linked to a minCMV promoter drove higher levels of luciferase expression than minCMV alone and SCP alone.

This experiment indicated that SEQ ID NO: 178 is a RE that drives high gene expression in a cell. Such RE can be added to an expression cassette disclosed herein comprising a non-naturally occurring transcriptional activator of GRN to increase expression of the transcriptional activator in a cell, which results in an increased expression of the endogenous GRN gene. In some cases, one or more REs having a sequence of SEQ ID NO: 178 is operably linked to a transcriptional activator to increase GRN expression in a cell. Such regulatory element can be added to an expression cassette upstream and/or downstream of a transcriptional activator in an expression cassette.

Example 19

Upregulation of Progranulin Transcript and Protein Levels in HEK293 Cells Using Progranulin Specific Transcription Factors HEK293 cells were cultured per standard methods, and transfected (FugeneHD, Promega) with 3 ug plasmid per well of a 6-well plate. Cells were transfected with plasmids containing the constructs shown below in TABLE 42. 48 h following transfection RNA was isolated from cells for qPCR analysis and media was collected from the infected wells to quantify secreted PGRN levels by ELISA analysis.

Figure 26:
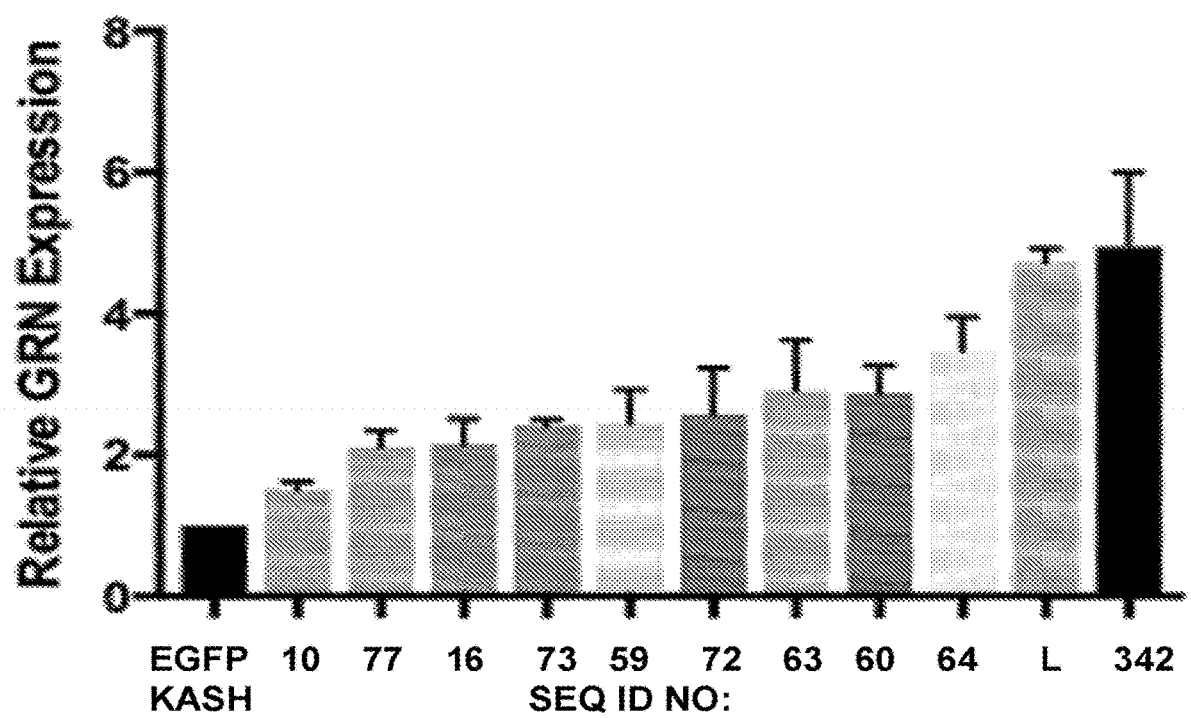
FIG. 26 illustrates the level of PGRN transcript as measured by qPCR in HEK293 cells that were transfected with plasmids expressing either EGFP or a GRN specific activator (SEQ ID NOs: 10, 16, 59, 60, 63, 64, 72, 73, 77, L, or 342). Data are presented as fold change relative to the control condition.

For qPCR analysis, cells were collected and RNA was isolated (Qiagen RNeasy Mini kit), and DNase treated. RNA (3 ug) was reverse transcribed using OligoDT primers (Superscript IV, Invitrogen). cDNA samples were analyzed by qPCR using Phusion Polymerase (New England Biolabs) and SYBR Green I: (30 s at 98° C., 40×[10 sec at 98° C., 15 sec at 66° C., 15 sec at 72° C.]). Primers against PGRN (5'-ATGGTCAGTTCTGCCCTGTG-3' (SEQ ID NO: 287); 5'-CGGTAAAGATGCAGGAGTGGC-3' (SEQ ID NO: 288)) were used to quantify levels of endogenous PGRN transcript, and relative levels of PGRN expression were determined by the delta-delta Ct method with GAPDH as a reference gene (5'-ACCACAGTCCATGCCATCAC3' (SQE ID NO: 192); 5'-TCCACCACCCTGTTGCTGTA-3' (SEQ ID NO: 193). Data are presented as fold changes relative to the control condition (see FIG. 26). Delivery of engineered transcription factors induced varying degrees of upregulation in endogenous GRN transcript with respect to the EGFP control condition.

Figure 27:
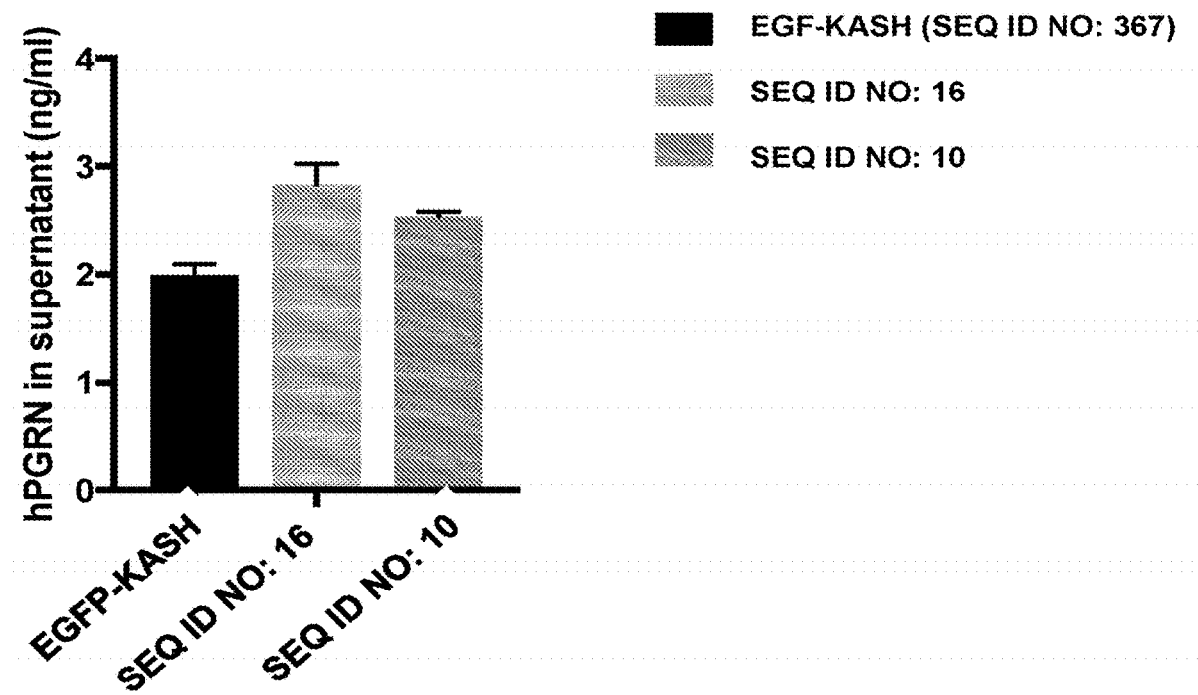
FIG. 27 illustrates the level of PGRN protein as measured by ELISA secreted from HEK293 cells that were transfected with plasmids expressing either EGFP or a GRN specific activator (SEQ ID NOs: 10 or 16). Data are presented as fold change relative to the control condition.

For ELISA analysis, cell culture media was collected on the specified day after virus infection, and was subjected to ELISA analysis using human PGRN ELISA kit (R&D systems, DPGRN0). ELISA procedure was performed according to manufacturer's instructions. Data are presented as fold changes relative to the control condition (see FIG. 27). These data confirm that upregulation of GRN by engineered transcription factors resulted in increased secretion of PGRN protein.

TABLE 42

GRN Constructs used in Example 19.
SEQ ID NO of eTF

SEQ ID NO: 10
SEQ ID NO: 16
SEQ ID NO: 59
SEQ ID NO: 341
SEQ ID NO: 63
SEQ ID NO: 60
SEQ ID NO: 64
SEQ ID NO: 335
SEQ ID NO: 336

Example 20

Upregulation of Progranulin Transcript and Protein Levels in GABA Neurons Using a Progranulin Specific Transcription Factor iCell GABA neurons (Cellular Dynamics) were plated in a 6-well plate (~1E6 cells/well) and maintained per manufacturer's recommended protocol. 72 h following plating, recombinant AAV (serotype AAV-DJ) expressing EGFP or activator (SEQ ID NO: 342) under the control of a CBA promoter was added to the culture media at approximately 2E11 genome copies/well. One week following infection RNA was isolated from cells for qPCR analysis and media was collected from the infected wells to quantify secreted PGRN levels by ELISA analysis.

Figure 28:
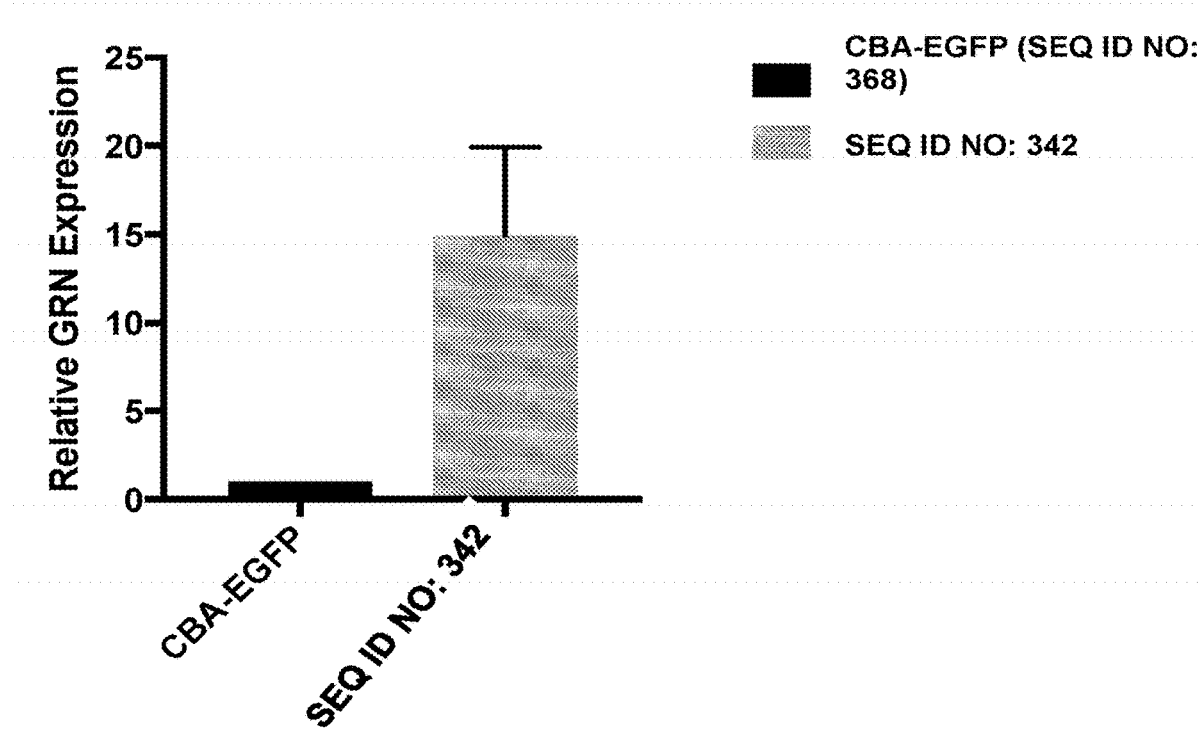
FIG. 28 illustrates the level of PGRN transcript as measured by qPCR in GABA neurons that were transfected with an AAV vector (serotype AAV-DJ) expressing either EGFP or a GRN specific activator (SEQ ID NO: 342) under the control of a CBA promoter. Data are presented as fold change relative to the control condition.

For qPCR analysis, RNA was isolated from cultured cells (Qiagen RNeasy Mini kit), and DNase treated. Recovered RNA was reverse transcribed using OligoDT primers (Superscript IV, Invitrogen). cDNA samples were analyzed by qPCR using Phusion Polymerase (New England Biolabs) and SYBR Green I: (30 s at 98° C., 40×[10 sec at 98° C., 15 sec at 66° C., 15 sec at 72° C.]). Primers against PGRN (5'-ATGGTCAGTTCTGCCCTGTG-3' (SEQ ID NO: 287); 5'-CGGTAAAGATGCAGGAGTGGC-3' (SEQ ID NO: 288)) were used to quantify levels of endogenous PGRN transcript, and relative levels of PGRN expression were determined by the delta-delta Ct method with GAPDH as a reference gene (5'-ACCACAGTCCATGCCATCAC'3' (SEQ ID NO: 192); 5'-TCCACCACCCTGTTGCTGTA-3' (SEQ ID NO: 193)). Data are presented as fold changes relative to the control condition (see FIG. 28). Delivery of SEQ ID NO: 342 produced a robust upregulation in endogenous GRN transcript with respect to the EGFP control condition.

Figure 29:
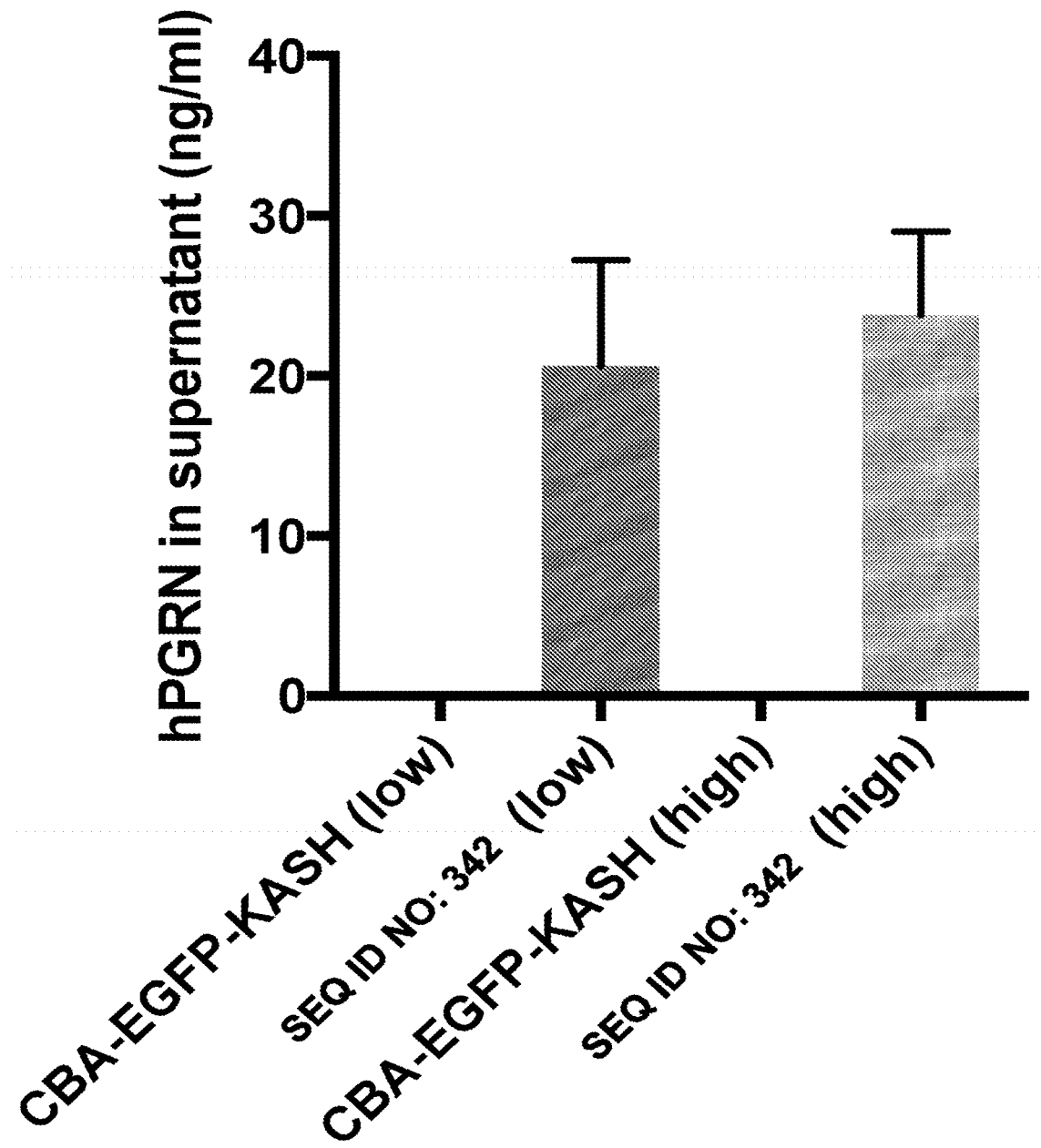
FIG. 29 illustrates the level of PGRN protein as measured by ELISA secreted from GABA neurons that were infected with low (0.5E11 genome copies/well) and high (2E11 genome copies/well) doses with an AAV vector (serotype AAV-DJ) expressing either EGFP or a GRN specific activator (SEQ ID NO: 342) under the control of a CBA promoter. Data are presented as fold change relative to the control condition.

For ELISA analysis, cell culture media was collected on the specified day after virus infection with either 0.5E11 genome copies/well (low dose condition) or 2E11 genome copies/well (high dose condition), and was subjected to ELISA analysis using human PGRN ELISA kit (R&D systems, DPGRN0). ELISA procedure was performed according to manufacturer's instructions. Data are presented as (see FIG. 29). These data confirm that upregulation of GRN by SEQ ID NO: 342 resulted in increased secretion of PGRN protein in cultured neurons.

Example 21

Increasing Plasma GRN Protein In Vivo

Figure 30:
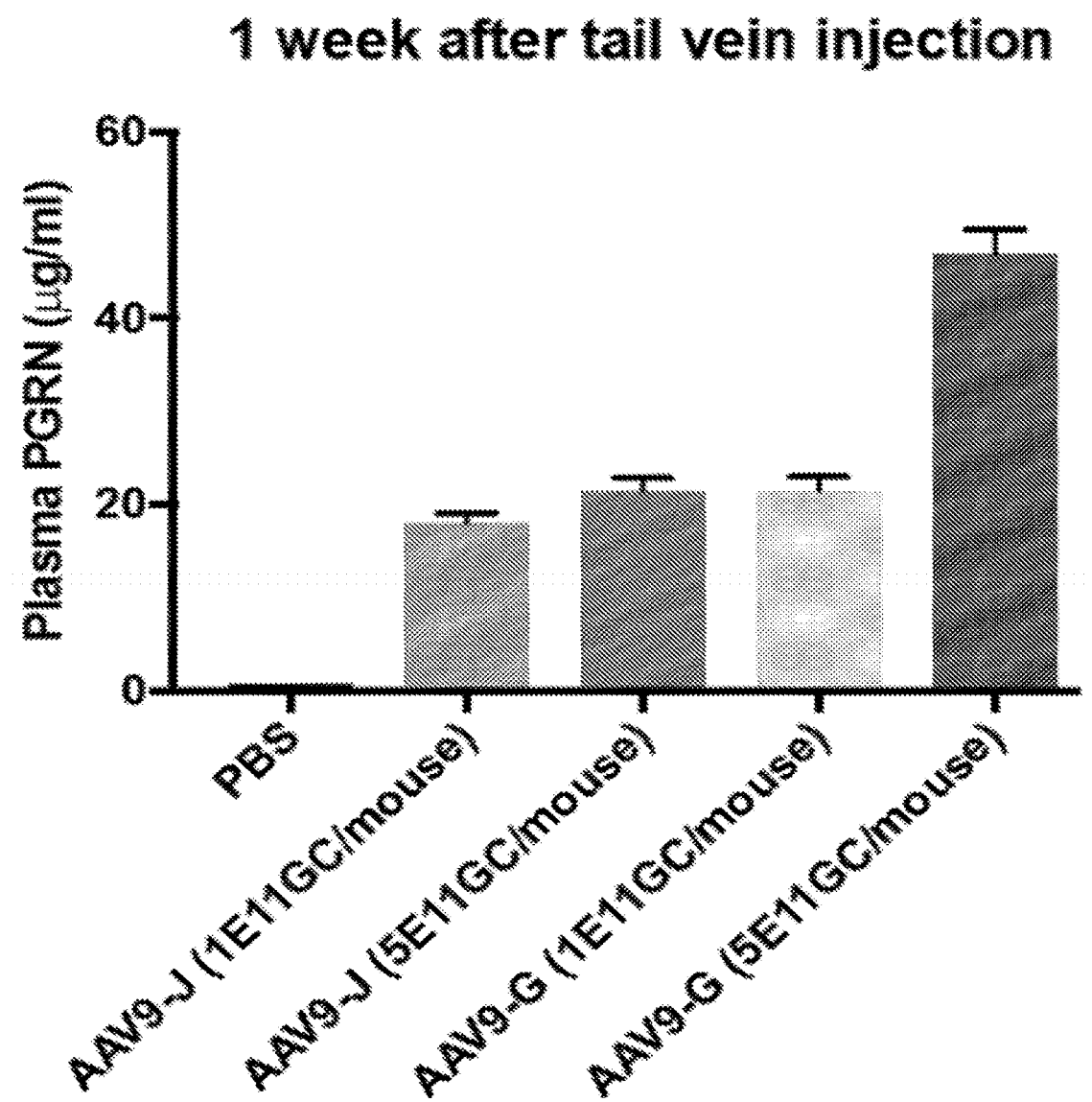
FIG. 30 illustrates levels of plasma PGRN protein, measured in µg/mL, for mice treated with AAV9 comprising expression cassette J or G, each comprising a transcriptional activator of GRN, at different doses as compared to a PBS control.

To test the expression of transcriptional activators of GRN in vivo, AAV9 comprising an expression cassette J or G, as described in TABLE 23 above was injected into mice. Purified AAV9 virus was generated at VectorBioLabs, and was reconstituted into 200 ul total volume (with PBS) prior to injection. 6-9 week old C57BL6 male animals were used for tail vein injection, after acclamation period. In-life blood collection was performed via tail vein bleeding, and plasma samples were generated using K2EDTA method. ELISA analysis was performed with mouse PGRN ELISA kit (Thermo Fisher Scientific) according to manufacturer manual. FIG. 30 illustrates the ELISA results in terms of plasma GRN in µg/mL for mice treated with different AAV9 constructs or control one week after injection. As compared to a PBS buffer control, all the mice treated with AAV9 comprising a GRN transcriptional activator showed pronounced increase in plasma GRN protein level. Different doses of AAV9-J and AAV9-G were tested: 1E11 genomic copies (GC) and 5E11 GC per mouse. For AAV9-G, increasing the genomic copies injected per mouse resulted in at least a two-fold increase in plasma GRN protein as compared to the lower dose at 1E11 GC/mouse.

Example 22

Driving High GRN Expression in Glial Cells

Selectivity for glial cells, or microglial cells in particular, can be determined using fluorescent imaging. AAV vectors containing eGFP reporter gene are operably linked to either a control promoter (EF1a) or a glia- or microglia-selective RE. Such AAV vectors are co-injected with a CRE-dependent tdTomato vector into a CRE mouse, wherein Cre is expressed in the glia or microglia in particular.

Mice are infused bilaterally with 1.5 µL of AAV vector ($5^{12}$ to $1^{13}$ gc/ml) into the frontal cortex or the striatum at a rate of 0.3 µL/min with a 4 min rest period following injection. After treatment, health and body weight of the mice are monitored each day. For tissue collection, mice are euthanized via isoflurane overdose and perfused with 4% Paraformaldehyde (PFA). To analyze the selective expression of the reporter gene in glial cells or microglia, a piece of brain tissue is obtained from the frontal cortex or striatum, sectioned, and stained for eGFP and tdTomato using standard immunohistochemistry procedures with anti-RFP polyclonal rabbit antibody (Rockland Antibodies and Assay) and anti-eGFP polyclonal chicken antibody (Ayes Labs). Using fluorescence microscopy, strong overlay between the fluorescence of eGFP reporter gene and tdTomato fluorescence as compared to the control indicates selective expression in glial cells or microglia.

This method can be used to identify regulatory elements that target high gene expression in the frontal cortex or other CNS cells, such as Purkinje cells, pyramidal cells (e.g., Betz cells), motor neurons, and cerebral cortical neurons, impacted by GRN deficiency.

Once regulatory elements that are selective for glial cells, microglia, or any other cell type in the CNS that is negatively affected by GRN deficiency have been identified, such regulatory elements can be operably linked to a transcriptional activator that targets GRN gene in an expression cassette described herein to selectively increase GRN expression in the target cell or tissue type in vivo. For example, REs selective for glial cells or microglial cells can be operatively linked to any one of the transcriptional activators of the expression cassettes described herein to selectively increase GRN in vivo.

Example 23

Increasing Plasma GRN Protein In Vivo

To test the expression of transcriptional activators of GRN in vivo, AAV9 comprising any of the expression cassettes described herein. Purified AAV9 virus can be generated at VectorBioLabs and reconstituted into 200 ul total volume (with PBS) prior to injection. 6-9 week old C57BL6 male animals can be used for tail vein injection, after acclamation period. In-life blood collection can be performed via tail vein bleeding, and plasma samples can be generated using K2EDTA method. ELISA analysis can be performed with mouse GRN ELISA kit (Thermo Fisher Scientific) according to manufacturer manual. As compared to a PBS buffer control, all the mice treated with AAV9 comprising a GRN transcriptional activator are expected to show pronounced increase in plasma GRN protein level. Different doses of AAV9-eTF can be tested, such as 1E11 genomic copies (GC) and 5E11 GC per mouse.

Example 24

Treating FTD Symptoms in Mouse

Heterozygous GRN-knockout mice, which present FTD symptoms, i.e., haploinsufficiency of GRN, provide an in vivo animal model for validating the compositions and methods described herein. AAV expression cassettes described herein, are injected into the mice to rescue GRN haploinsufficiency by increasing expression levels of GRN in vivo. Once expression cassettes are delivered into the mice via injection/infusion, rescue of the GRN haploinsufficiency can be monitored over time using various methods, such as measuring levels of secreted GRN in blood samples, measuring the transcription of GRN using PCR methods, and/or measuring behavioral changes (e.g., motor coordination, learning, socialization with other mice, and other cognitive functions) in the treated mice as compared to a control and/or untreated group.

Similar methods can be used in mice models of Alzheimer's disease, Parkinson's disease, and atherosclerosis (e.g., measuring a reduction in arterial wall thickening in mice post treatment using the expression cassettes described herein).

Example 25

Reporter System Screening

HEK293 cells were cultured per standard methods, and co-transfected (FuGene HD, Promega) with 1.5 ug of a reporter plasmid consisting of EGFP under the control of a tetracycline-responsive element (TRE) tight promoter, and 1.5 ug of each tested activator, or empty vector control (pUC57). 48 h following transfection, cells were imaged using an epifluorescent microscope for GFP expression. The cells were collected and RNA was isolated (Qiagen RNeasy Mini kit), and DNase treated. RNA (3 ug) was reverse transcribed using OligoDT primers (Superscript IV, Invitrogen). cDNA samples were analyzed by qPCR using Phusion Polymerase (New England Biolabs) and SYBR Green I: (30 s at 98° C., 40×[10 sec at 98° C., 15 sec at 65° C., 15 sec at 72° C.]). Primers against EGFP (5'-GCTACCCCGACCA-CATGAAG-3' (SEQ ID NO: 369); 5'-TCTTGTAGTTGCCGTCGTCC-3' (SEQ ID NO: 370)) were used to quantify levels of reporter-driven EGFP transcript, and relative levels of EGFP expression were determined by the delta-delta Ct method with GAPDH as a reference gene (5'-ACCACAGTCCATGCCATCAC-3' (SEQ ID NO: 192); 5'-TCCACCACCCTGTTGCTGTA-3' (SEQ ID NO: 193)).

Figure 31A:
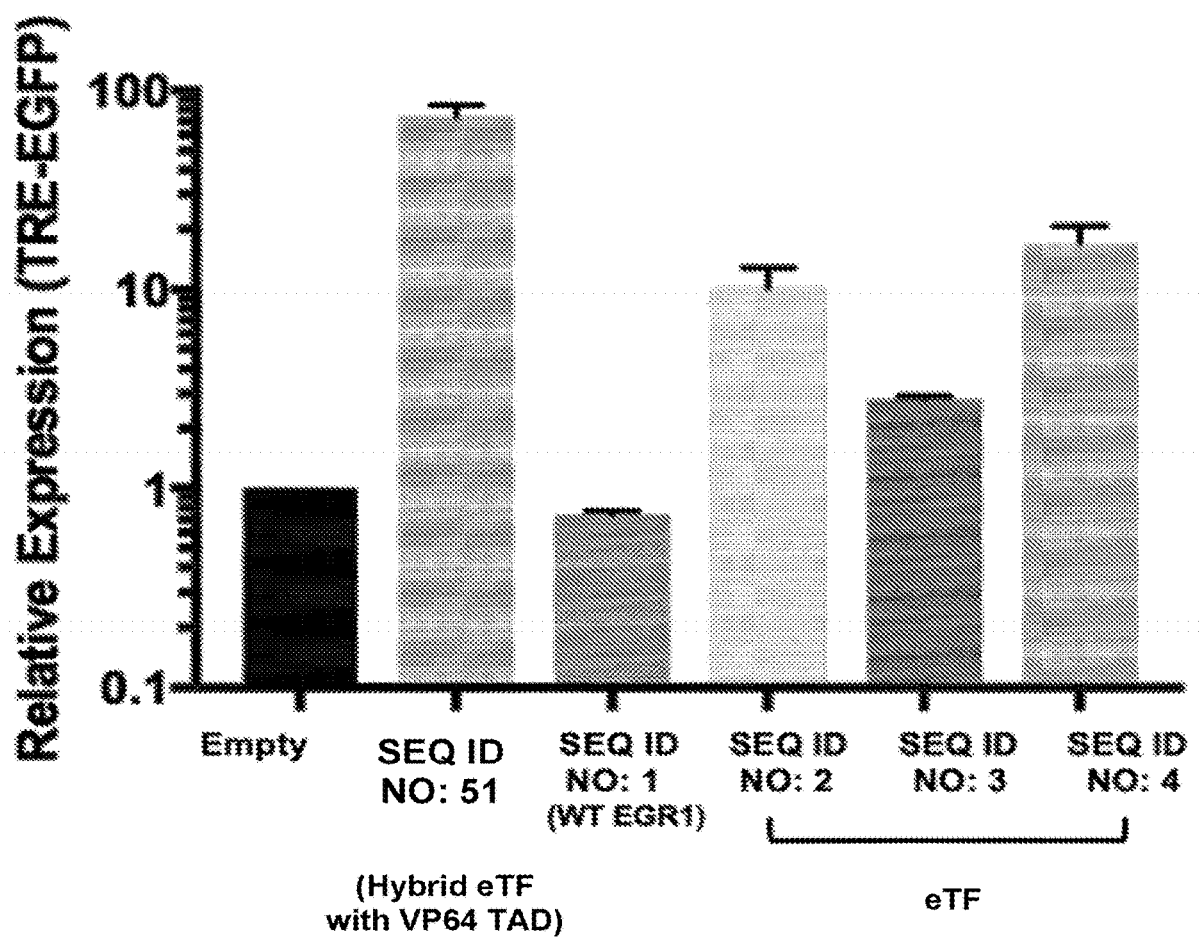
FIG. 31A illustrates quantification of the results of the reporter (EGFP) activation assay with various eTFs, expressed as relative EGFP expression as compared to an empty vector control. The artificial transcription factor (SEQ ID NO: 51) comprising a strong viral activation domain resulted in 70-fold relative EGFP expression. An unmodified human transcription factor EGR1 (SEQ ID NO: 1) did not activate the reporter gene relative to the control (empty vector). An eTF derived from EGR1 (SEQ ID NO: 2) comprising six engineered zinc fingers resulted in 10-fold EGFP expression. An eTF derived from EGR1 (SEQ ID NO: 3) comprising three zinc fingers with at least one or more amino acid changes in its zinc fingers resulted in 3-fold relative EGFP expression. Duplicating the zinc fingers in EGR1 fingers (SEQ ID NO: 4) resulted in 15-fold relative EGFP expression.
Figure 31B:
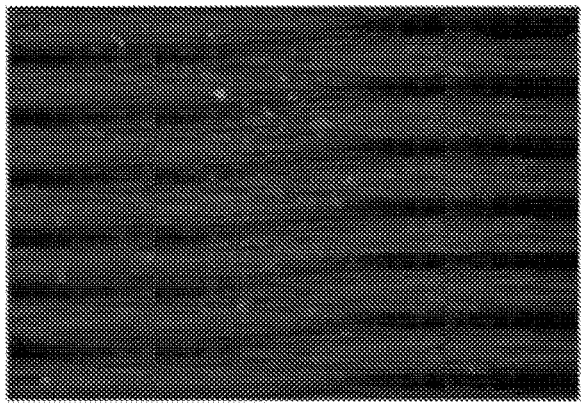
FIG. 31B illustrates the fluorescent photomicrographs of the reporter (EGFP) activation assay quantified in FIG. 31A. Cells that express EGFP appear as light gray color.
Figure 31B:
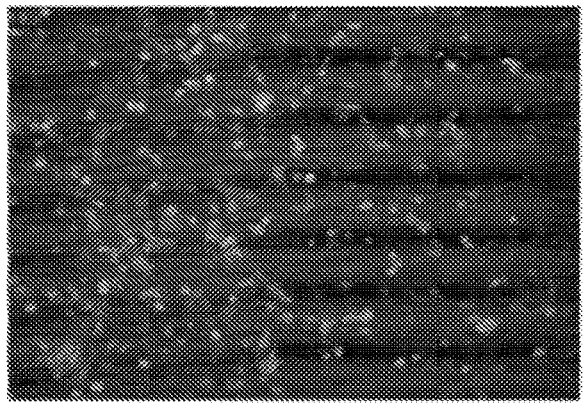
Figure 31B:
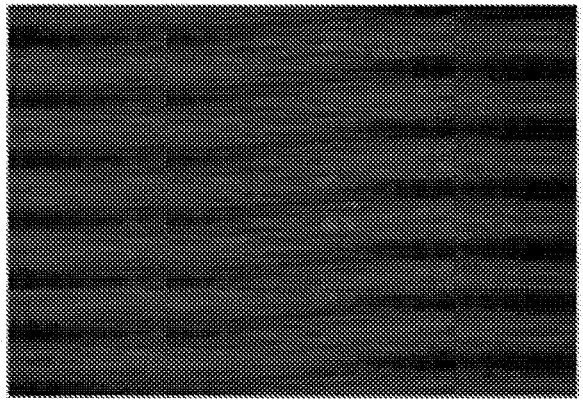
Figure 31B:
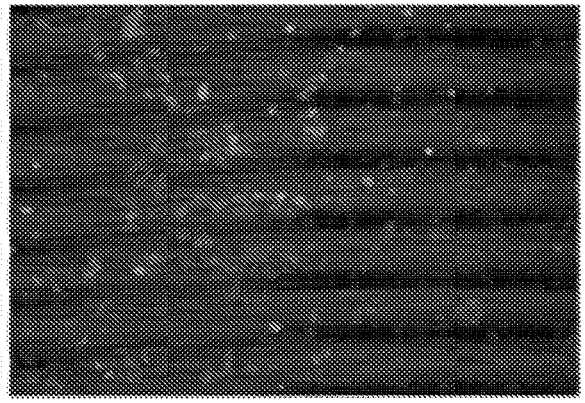
Figure 31B:
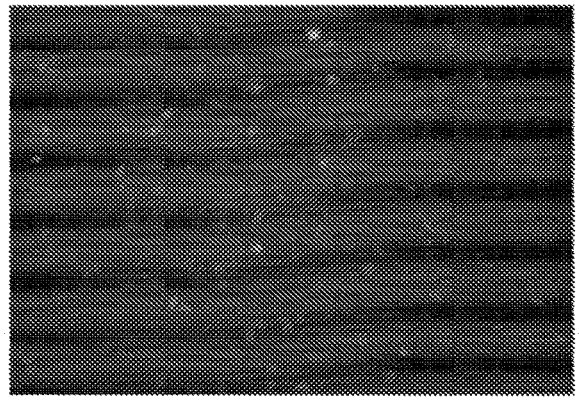
Figure 31B:
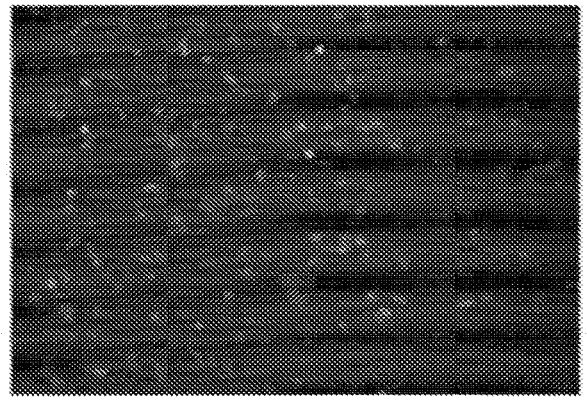
Figure 32:
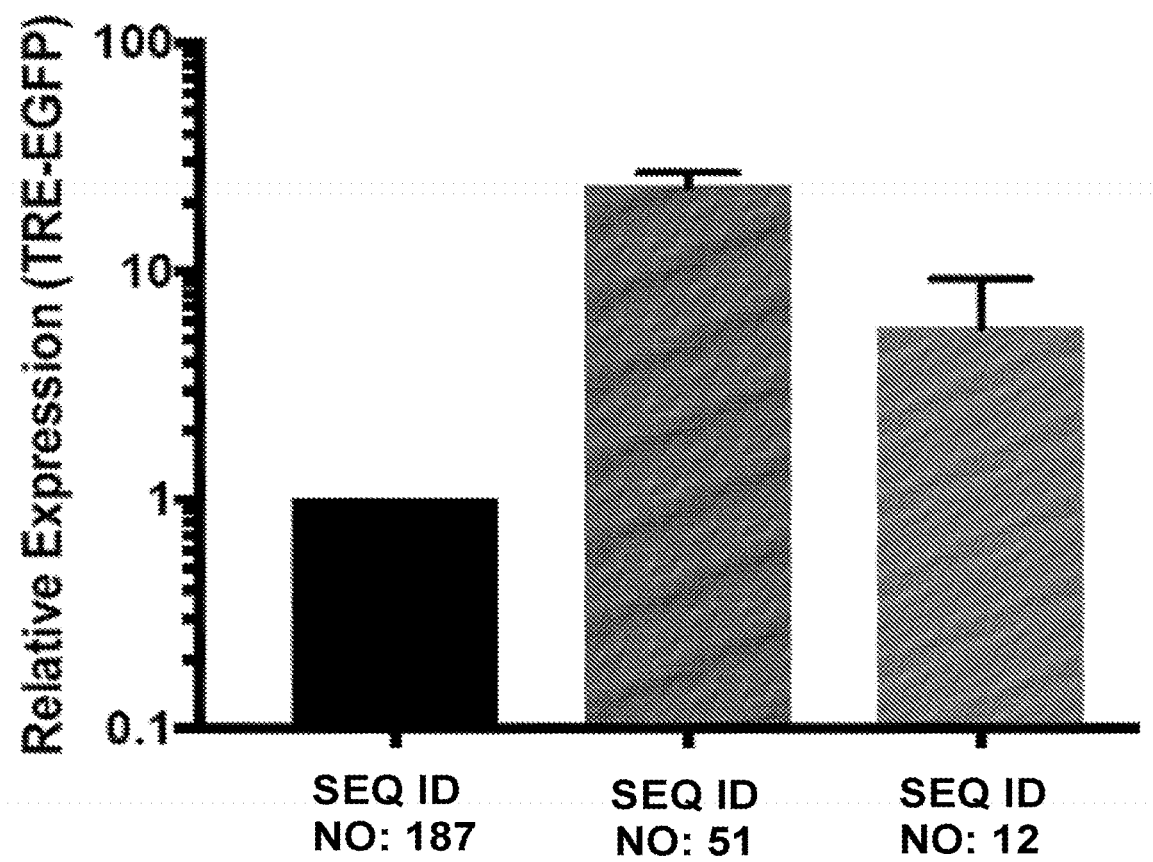
FIG. 32 illustrates various embodiments of eTFs derived from EGR3 and engineered to recognize a target binding site that results in expression of the EGFP report gene. An eTF (SEQ ID NO: 12) comprising six zinc fingers derived from EGR3 protein and engineered to recognize the TRE binding site in the reporter assay resulted in EGFP expression similarly to an eTF derived from EGR1 (SEQ ID NO: 51), comprising a TAD derived from VP64. Both eTFs resulted in high EGFP expression as compared to a control comprising a modified human DBD without an activation domain (encoded by SEQ ID NO: 187).
Figure 33A:
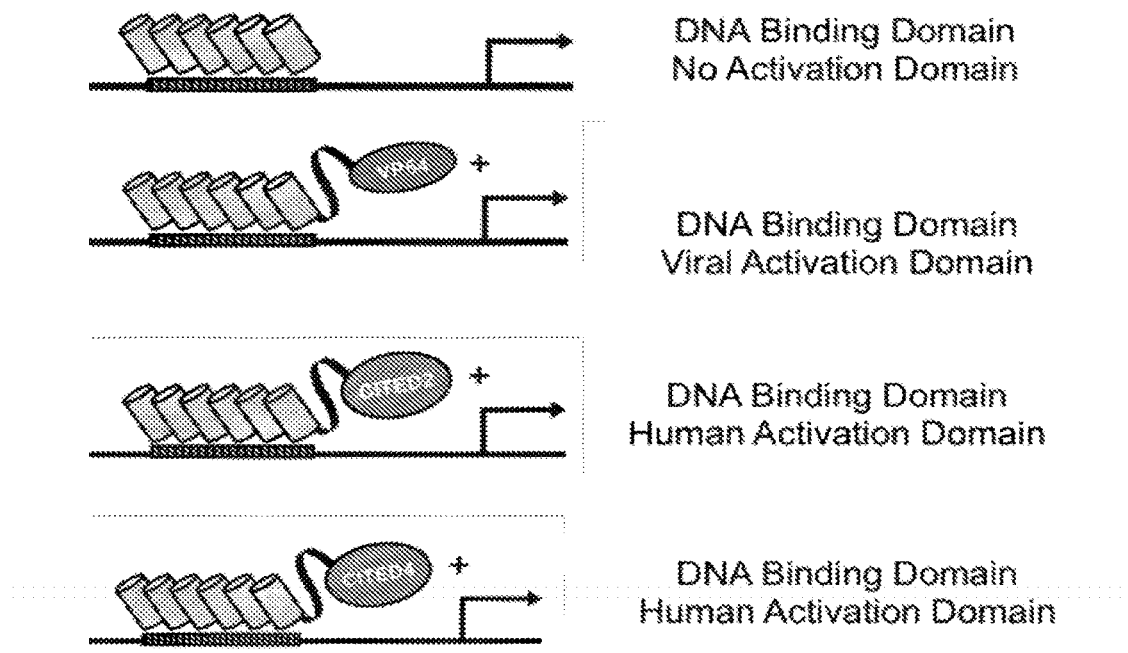
FIG. 33A illustrates schematics of various eTFs engineered to recognize the TRE binding sequence in an EGFP reporter activation assay. The first figure illustrates a modified human DBD engineered to recognize the TRE binding site but lacks an activation domain (SEQ ID NO: 50), which does not result in any activation of EGFP expression. In the second figure, a modified human DBD is fused to a strong viral activation domain VP64 (SEQ ID NO: 95) results in activation of EGFP expression. In the third and fourth figures, a modified human DBD is fused to a human activation domain, either CITED2 (SEQ ID NO: 96) or CITED4 (SEQ ID NO: 97), both of which activate EGFP expression.
Figure 33B:
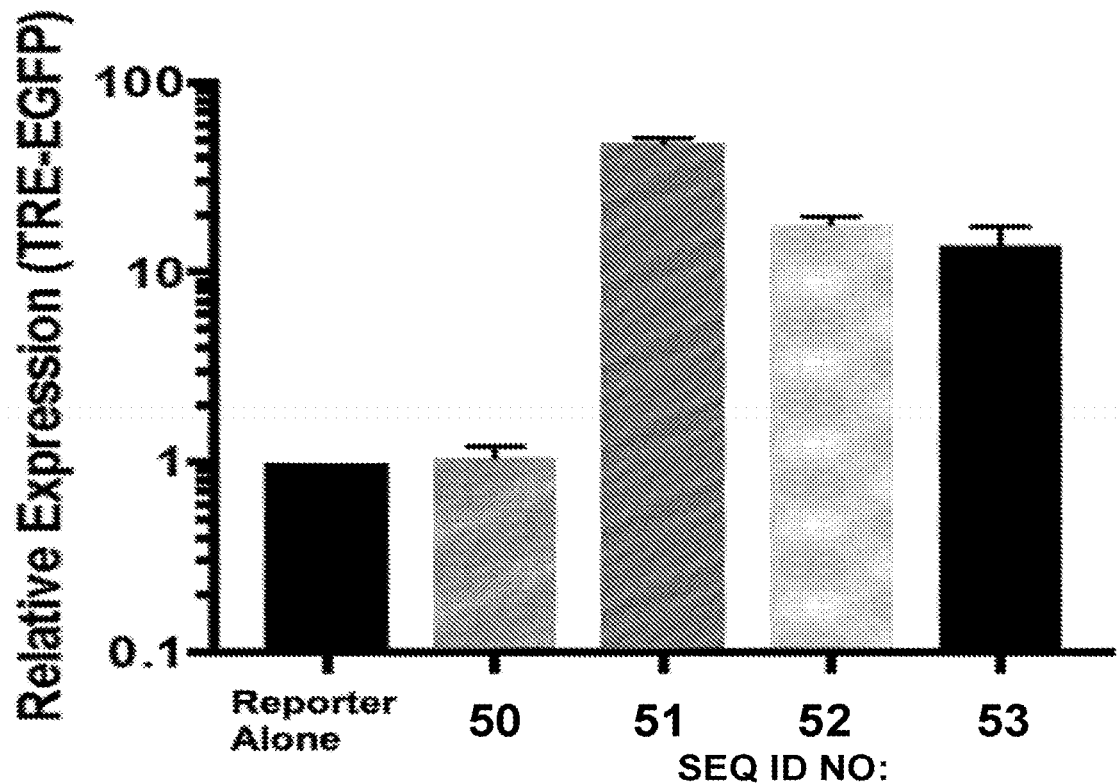
FIG. 33B illustrates quantitation of relative EGFP expression for each eTF described in FIG. 33A. SEQ ID NO: 50 resulted in similar level of EGFP expression as the reporter alone control. eTFs having sequences of SEQ ID NOs: 51-53 each resulted in about 40, 15, and 10-fold relative EGFP expression as compared to the reporter alone control, respectively.
Figure 33C:
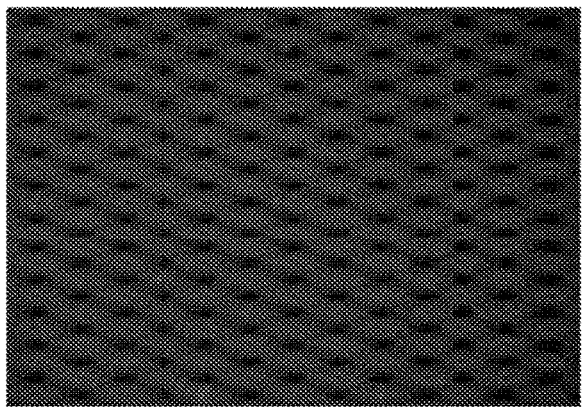
FIG. 33C illustrates the fluorescent photomicrographs for each eTF in the EGFP reporter activation assay illustrated in FIG. 33A and quantified in FIG. 33B.
Figure 33C:
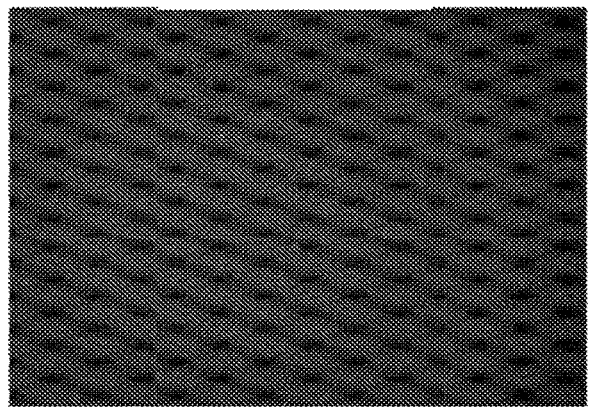
Figure 33C:
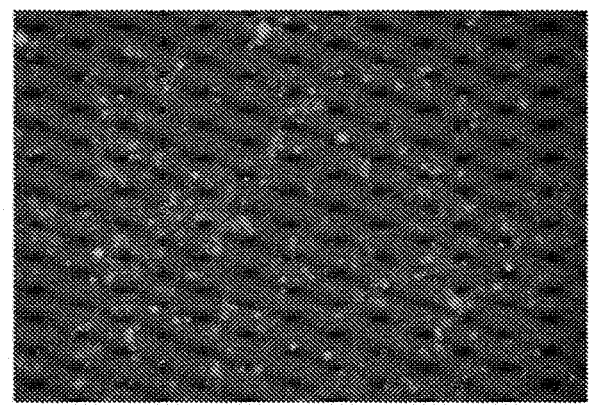
Figure 33C:
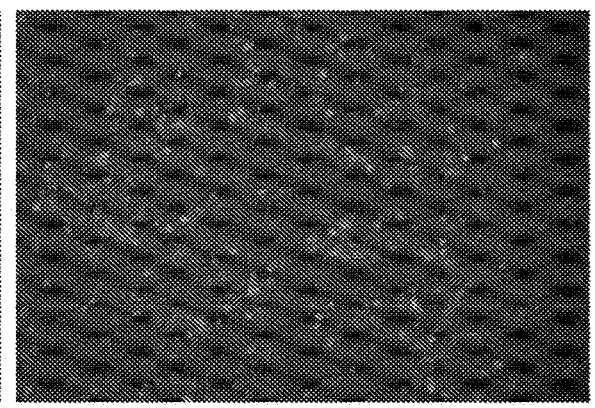
Figure 33C:
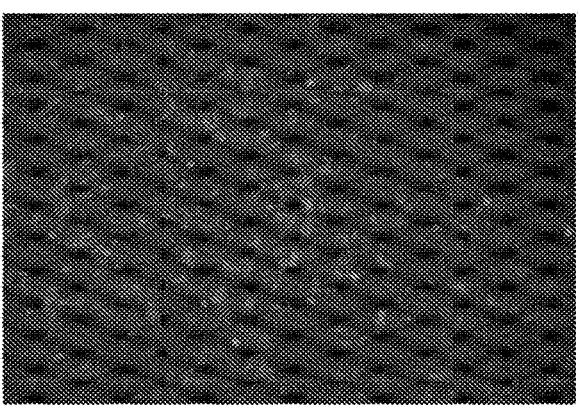
Figure 34:
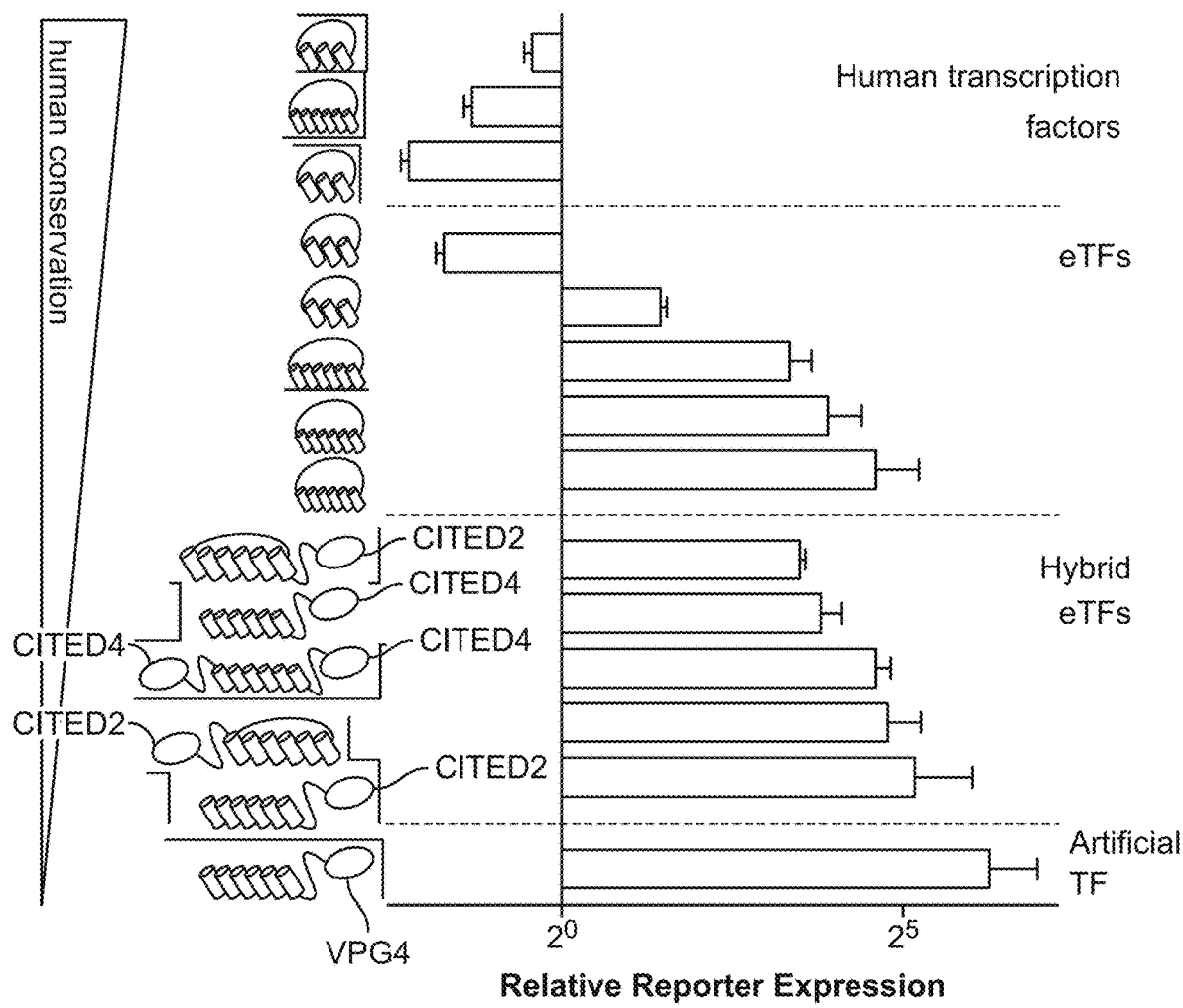
FIG. 34 illustrates a summary of various embodiments of eTFs with a broad range of transcriptional activity (or relative reporter expression) and varying degrees of sequence identity (or conservation) with naturally occurring human proteins.
Figure 35A:
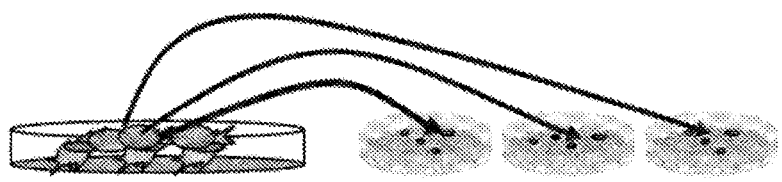
FIG. 35A illustrates a schematic of Elispot assay for testing immunogenicity of an eTF disclosed herein. Elispot assay is used to test whether T cells from normal healthy donors can recognize and respond to peptides predicted to be immunogenic. T cells are mixed with antigen presenting cells (e.g., dendritic cells or DCs) with pools of peptides to be tested in elispot wells. If T cells recognize the peptides as foreign, T cells become activated, proliferate, and secrete cytokines (such an interferon-gamma). After processing with developing reagents, the interferon-gamma (IFNγ) positive spots can be counted. A higher number of spots as compared to a control (e.g., a known non-immunogenic peptide or buffer alone) correlates with higher immunogenicity.
Figure 35A:
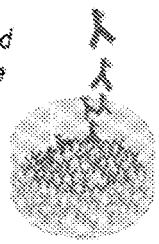
Figure 35A:
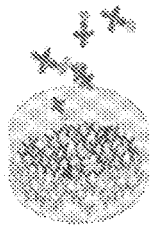
Figure 35A:
Figure 35A:
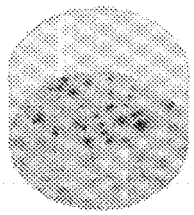
Figure 35B:
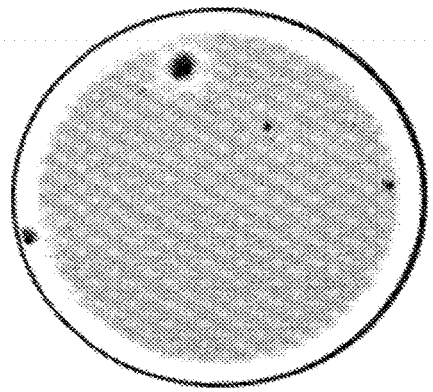
FIG. 35B illustrates a close-up example of an elispot result showing increased immunogenicity (right circle) as compared to a control (left circle). IFN-gamma positive spots are shown as black spots.
Figure 35B:
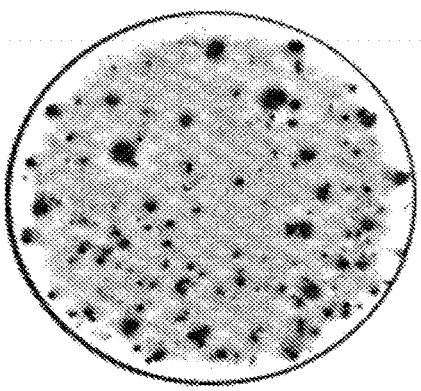

Data are presented as fold changes relative to the control condition. See FIG. 31A and FIG. 31B illustrate eTFs of SEQ ID NOs: 2-4 resulted in increased EGFP expression as compared to the empty vector control. eTF of SEQ ID NO: 51 comprising a viral VP64 TAD resulted in the highest level of relative EGFP expression. As illustrated in FIG. 32, eTF comprising SEQ ID NO: 12 resulted in at least 5-fold relative EGFP expression as compared to control SEQ ID NO: 187. FIG. 33 illustrates eTFs of SEQ ID NOs: 51-53 resulted in over 10-fold relative EGFP expression as compared to reporter alone or control protein (SEQ ID NO: 50) without a TAD.

Various embodiments of this disclosure are defined with reference to the following numbered clauses:

1. A nucleic acid cassette encoding a non-naturally occurring DNA binding protein comprising three or more DNA binding domains, wherein the non-naturally occurring DNA binding protein increases or represses expression of an endogenous gene by a factor of at least 1.5, 2, 3, 4, 5, 6, 7, 8, 9, 10, 20, 25, 50, or 100-fold, wherein the non-naturally occurring DNA binding protein has at least 80%, 81%, 82%, 83%, 84%, 85%, 86%, 87%, 88%, 89%, 90%, 91%, 92%, 93%, 94%, 95%, 96%, 97%, 98%, or 99% local sequence identity to a corresponding domain of a naturally occurring human protein (e.g., within a DNA binding domain or a transcription effector domain between the two proteins), or at least 90%, 91%, 92%, 93%, 94%, 95%, 96%, 97%, 98%, or 99% global sequence identity to a naturally occurring human protein (e.g., EGR1 or EGR3).
2. A nucleic acid cassette encoding a non-naturally occurring DNA binding protein comprising a plurality of binding domains that collectively bind to at least 21 bases in a human genome and has at least 80%, 81%, 82%, 83%, 84%, 85%, 86%, 87%, 88%, 89%, 90%, 91%, 92%, 93%, 94%, 95%, 96%, 97%, 98%, or 99% local sequence identity to a corresponding domain of a naturally occurring human protein (e.g., within a DNA binding domain or a transcription effector domain between the two proteins), or at least 90%, 91%, 92%, 93%, 94%, 95%, 96%, 97%, 98%, or 99% global sequence identity to a naturally occurring human protein (e.g., EGR1 or EGR3).
3. The nucleic acid cassette of clause 1 or 2, wherein the DNA binding protein binds to a target site that the human counterpart does not bind.
4. The nucleic acid cassette of any one of clauses 1-3, wherein the human counterpart is EGR1 or EGR3.
5. The nucleic acid cassette of any one of clauses 1-4, wherein the binding domains are zinc fingers.
6. The nucleic acid cassette of any one of clauses 1-5, wherein the binding domains comprise a duplication or triplication of a binding domain of the human counterpart.
7. The nucleic acid cassette of any one of clauses 1-5, wherein the binding domains comprise 2, 3, 4, 5, 6, 7, 8, or 9 copies of a DNA binding domain or a zinc finger of the human counterpart.
8. The nucleic acid cassette of any one of clauses 1-7, wherein the non-naturally occurring DNA binding protein comprises at least 6, 7, 8, 9, 10, 11, or 12 zinc fingers.
9. The nucleic acid cassette of any one of clauses 1-8 wherein the endogenous gene is SCN1A or GRN.
10. The nucleic acid cassette any one of clauses 1-9, wherein the DNA binding protein recognizes a binding site at a genomic location such that binding at the site allows the DNA binding protein to modulate expression of the endogenous gene.
11. The nucleic acid cassette of any one of clauses 1-10, wherein the DNA binding protein recognizes a binding site located near or at an endogenous SCN1A or GRN gene locus.
12. The nucleic acid cassette of any one of clauses 1-11, wherein the DNA binding protein recognizes a binding site having a sequence of: (i) SEQ ID NOs: 35-38, 105-111, 113, 136, 195-211, 224-238, 240-267, or 330-336; (ii) a variant thereof; (iii) a sequence having at least 90%, 91%, 92%, 93%, 94%, 95%, 96%, 97%, 98%, or 99% sequence identity to any one of (i) or (ii); or (iv) a genomic region within 5 bp, 10 bp, 50 bp, 100 bp, 200 bp, or 500 bp thereof.

13. The nucleic acid cassette of any one of clauses 1-11, wherein the DNA binding protein recognizes a binding site having a sequence of: (i) SEQ ID NOs: 36 or 38; (ii) a variant thereof; (iii) a sequence having at least 90%, 91%, 92%, 93%, 94%, 95%, 96%, 97%, 98%, or 99% sequence identity to any one of (i) or (ii); or (iv) a genomic region within 5 bp, 10 bp, 50 bp, 100 bp, 200 bp, or 500 bp thereof.

14. The nucleic acid cassette of any one of clauses 1-12, wherein the DNA binding protein has a sequence of: (i) SEQ ID NOs: 22-26, 29-32, 84-93, 112, 131-135, 165-171, 371-372, 376-409, or 412-416; (ii) a variant or functional fragment thereof; or (iii) a sequence having at least 90%, 91%, 92%, 93%, 94%, 95%, 96%, 97%, 98%, or 99% sequence identity to any one of (i) or (ii).

15. The nucleic acid cassette of any one of clauses 1-11 and 13, wherein the DNA binding protein has a sequence of: (i) SEQ ID NOs: 6-10, 13-16, 57-61, 63, 64, 67-73, 74-77, 268-282, 295-299, 337-350, or 365-366; (ii) a variant or functional fragment thereof; or (iii) a sequence having at least 90%, 91%, 92%, 93%, 94%, 95%, 96%, 97%, 98%, or 99% sequence identity to any one of (i) or (ii).

16. The nucleic acid cassette of any one of clauses 1-15, wherein the DNA binding protein comprises a transcription effector domain derived from EGR1 or EGR3.

17. The nucleic acid cassette of one of clauses 1-15, wherein the DNA binding protein comprises a transcription effector domain derived from CITED2 or CITED4.

18. The nucleic acid cassette of one of clauses 16-17, wherein the effector domain is positioned at C-terminus of the DNA binding domains in the DNA binding protein.

19. The nucleic acid cassette of one of clauses 16-17, wherein the effector domain is positioned at N-terminus of the DNA binding domains in the DNA binding protein.

20. The nucleic acid cassette of one of clauses 1-19, wherein the DNA binding domains collectively comprise a sequence of: (i) SEQ ID NOs: 22-26, 29-32, 84-93, 112, 131-135, 165-171, 371-372, 376-409, or 412-416; (ii) a variant or functional fragment thereof; or (iii) a sequence having at least 90%, 91%, 92%, 93%, 94%, 95%, 96%, 97%, 98%, or 99% sequence identity to any one of (i) or (ii).

21. The nucleic acid cassette of one of clauses 1-20, wherein the DNA binding protein comprises an effector domain having a sequence of: (i) SEQ ID NOs: 95-100 or 114, (ii) a variant or functional fragment thereof; or (iii) a sequence having at least 90%, 91%, 92%, 93%, 94%, 95%, 96%, 97%, 98%, or 99% sequence identity to any one of (i) or (ii).

22. The nucleic acid cassette of one of clauses 1-21, wherein the DNA binding domains comprise at least one amino acid substitution at position −1, 2, 3 or 6 of recognition helices of zinc fingers in the domains.

23. The nucleic acid cassette of one of clauses 1-22, wherein the DNA binding protein recognizes a target binding site of 18 nt or longer, 21 nt or longer, or 24 nt or longer.

24. The nucleic acid cassette of one of clauses 1-23, wherein the sequence identity is measured using BLAST or ClustalW 25. The nucleic acid cassette of one of clauses 1-24, wherein the DNA binding protein is in a viral vector.

26. The nucleic acid cassette of clause 25, wherein the viral vector is AAV.

27. The nucleic acid cassette of clause 26, wherein the AAV is AAV9.

28. The nucleic acid cassette of any one of clauses 1-27, wherein the non-naturally occurring DNA binding protein has comparable immunogenicity as its human counterpart, as measured by elispot assay (e.g., wherein comparable refers to an immunogenicity level within 1%, 2%, 3%, 4%, 5%, 6%, 7%, 8%, 9%, or 10% of the immune response generated by the naturally occurring human protein).

29. An AAV vector comprising a nucleic acid cassette encoding a non-naturally occurring DNA binding protein having >90% sequence identity to a human protein, or at least 80%, 81%, 82%, 83%, 84%, 85%, 86%, 87%, 88%, 89%, 90%, 91%, 92%, 93%, 94%, 95%, 96%, 97%, 98%, or 99% local sequence identity to a corresponding domain of a naturally occurring human protein (e.g., within a DNA binding domain or a transcription effector domain between the two proteins), or at least 90%, 91%, 92%, 93%, 94%, 95%, 96%, 97%, 98%, or 99% global sequence identity to a naturally occurring human protein (e.g., EGR1 or EGR3), and comprising a DNA binding domain comprising a plurality of binding motifs that collectively bind >9, >10, >11, >12, >13, >14, >15, >16, >17, >18, >19, >20, >21, >22, >23, >24, >25, >26, >27, >28, >29, or >30 bases.

30. The AAV vector of clause 29, wherein the non-naturally occurring DNA binding protein binds to a target site in human genome that the human protein does not bind.

31. The AAV vector of any one of clauses 29-30, wherein the human protein is EGR1 or EGR3.

32. The AAV vector of any one of clauses 29-31, wherein the DNA binding domain comprises at least 6, 7, 8, 9, 10, 11, or 12 zinc fingers.

33. The AAV vector of any one of clauses 29-32, wherein the DNA binding domain comprises a duplication, triplication, or quadruplication of a DNA binding domain in the human protein.

34. The AAV vector of any one of clauses 29-33, wherein the non-naturally occurring DNA binding protein recognizes a target binding site near or at a genomic locus of SCN1A or GRN (e.g., genomic loci as described in TABLE 1, or upstream of a start codon of endogenous SCN1A or GRN.

35. The AAV vector of any one of clauses 29-34, wherein the non-naturally occurring DNA binding protein modulates expression (e.g., increase expression) of endogenous SCN1A or GRN.

36. The AAV vector of any one of clauses 29-35, wherein the non-naturally occurring DNA binding protein recognizes a binding site comprising a sequence of: (i) SEQ ID NOs: 35-38, 105-111, 113, 136, 195-211, 224-238, 240-267, or 330-336; (ii) a variant thereof; (iii) a sequence having at least 90% sequence identity (or at least 90%, 91%, 92%, 93%, 94%, 95%, 96%, 97%, 98%, or 99% sequence identity) to any one of (i) or (ii); or (iv) a genomic region within 5 bp, 10 bp, 50 bp, 100 bp, 200 bp, or 500 bp thereof.

37. The AAV vector of any one of clauses 29-36, wherein the non-naturally occurring DNA binding protein comprises a sequence of: (i) SEQ ID NOs: 6-9, 13-15, 44-45, 48-49, 54-55, 58-62, 67-77, 103, 112, 114, 268-282, 305-325, 337-350, 364, 295-299, 365-366; (ii) a variant or functional fragment thereof; or (iii) a sequence having at least 90% sequence identity (or at least 91%, 92%, 93%, 94%, 95%, 96%, 97%, 98%, or 99% sequence identity) to any one of (i) or (ii).

38. The AAV vector of any one of clauses above, wherein the non-naturally occurring DNA binding protein comprises a sequence of: (i) SEQ ID NOs: 22-26, 29-32, 84-93, 112, 131-135, 165-171, 371-372, 376-409, or 412-416; (ii) a variant or functional fragment thereof; or (iii) a sequence having at least 90% sequence identity (or at least 91%, 92%, 93%, 94%, 95%, 96%, 97%, 98%, or 99% sequence identity) to any one of (i) or (ii).

39. The AAV vector of any one of clauses 29-38, wherein the non-naturally occurring DNA binding protein comprises a transcription effector domain of EGR1 or EGR3.

40. The AAV vector of any one of clauses 29-39, wherein the non-naturally occurring DNA binding protein comprises a transcription effector domain of CITED2 or CITED4.

41. The AAV vector of any one of clauses 39-40, wherein the effector domain is positioned at C-terminus of the DNA binding domain in the DNA binding protein.

42. The AAV vector of any one of clauses 39-41, wherein the effector domain is positioned at N-terminus of the DNA binding domain in the DNA binding protein.

43. The AAV vector of any one of clauses 29-42, wherein the DNA binding domain comprises a sequence of: (i) SEQ ID NOs: 22-26, 29-32, 84-93, 112, 131-135, 165-171, 371-372, 376-409, or 412-416; (ii) a variant or functional fragment thereof; or (iii) a sequence having at least 90% sequence identity (or at least 91%, 92%, 93%, 94%, 95%, 96%, 97%, 98%, or 99% sequence identity) to any one of (i) or (ii).

44. The AAV vector of any one of clauses 29-43, wherein the DNA binding protein comprises an effector domain having a sequence of: (i) SEQ ID NOs: 95-100 or 114 (ii) a variant or functional fragment thereof; or (iii) a sequence having at least 90% sequence identity (or at least 91%, 92%, 93%, 94%, 95%, 96%, 97%, 98%, or 99% sequence identity) to any one of (i) or (ii).

45. The AAV vector of any one of clauses 29-44, wherein the DNA binding domain comprises at least one amino acid substitution at position −1, 2, 3 or 6 of recognition helices of zinc fingers in the domain.

46. The AAV vector of any one of clauses 29-45, wherein the DNA binding protein recognizes a target binding site of 18 nt or longer, 21 nt or longer, or 24 nt or longer.

47. The AAV vector of any one of clauses 29-46, wherein the non-naturally occurring DNA binding protein has comparable immunogenicity as the human protein, as measured by elispot assay (e.g., wherein comparable refers to an immunogenicity level within 1%, 2%, 3%, 4%, 5%, 6%, 7%, 8%, 9%, or 10% of the immune response generated by the naturally occurring human protein).

48. The AAV vector of any one of clauses 29-47, wherein the sequence identity is measured using BLAST or ClustalW.

49. The AAV vector of any one of clauses 29-48, wherein the AAV is AAV9.

50. A vector encoding a non-naturally occurring DNA binding protein having 90% or greater sequence identity to a human protein, or at least 80%, 81%, 82%, 83%, 84%, 85%, 86%, 87%, 88%, 89%, 90%, 91%, 92%, 93%, 94%, 95%, 96%, 97%, 98%, or 99% local sequence identity to a corresponding domain of a naturally occurring human protein (e.g., within a DNA binding domain or a transcription effector domain between the two proteins), or at least 90%, 91%, 92%, 93%, 94%, 95%, 96%, 97%, 98%, or 99% global sequence identity to a naturally occurring human protein (e.g., EGR1 or EGR3), wherein the DNA binding protein is capable of modulating expression of an endogenous human gene.

51. The vector of clause 50, wherein the non-naturally occurring DNA binding protein comprises a DNA binding domain that recognizes a target binding site that is at least 9 bp long.

52. The vector of any one of clauses 50-51, wherein the non-naturally occurring DNA binding protein comprises a DNA binding domain that recognizes a target binding site that is at least 12 bp, 15 bp, 18 bp, 21 bp, or 24 bp long.

53. The vector of clause any one of clauses 50-52, wherein the DNA binding protein binds to a target site in human genome not recognized by human EGR1 or EGR3.

54. The vector of any one of clauses 50-53, wherein the endogenous human gene is SCN1A or GRN.

55. The vector of any one of clauses 50-54, wherein the DNA binding protein recognizes a target binding site near or at a genomic locus of SCN1A or GRN (e.g., genomic locus as described in TABLE 1), or upstream a start codon of endogenous SCN1A or GRN.

56. The vector of any one of clauses 50-55, wherein the DNA binding protein comprises at least 6, 7, 8, 9, 10, 11 or 12 zinc fingers.

57. The vector of any one of clauses 50-56, wherein the DNA binding protein comprises a duplication, triplication, or quadruplication of a DNA binding domain or one or more zinc fingers of EGR1 or EGR3.

58. The vector of any one of clauses 50-57, wherein the DNA binding protein recognizes a binding site comprising a sequence of: (i) SEQ ID NOs: 35-38, 105-111, 113, 136, 195-211, 224-238, 240-267, or 330-336; (ii) a variant thereof; (iii) a sequence having at least 90% sequence identity (or at least 91%, 92%, 93%, 94%, 95%, 96%, 97%, 98%, or 99% sequence identity) to any one of (i) or (ii); or (iv) a genomic region within 5 bp, 10 bp, 50 bp, 100 bp, 200 bp, or 500 bp thereof.

59. The vector of any one of clauses 50-58, wherein the DNA binding protein comprises a sequence of: (i) SEQ ID NOs: 22-26, 29-32, 84-93, 112, 131-135, 165-171, 371-372, 376-409, or 412-416; (ii) a variant or functional fragment thereof; or (iii) a sequence having at least 90% sequence identity (or at least 91%, 92%, 93%, 94%, 95%, 96%, 97%, 98%, or 99% sequence identity) to any one of (i) or (ii).

60. The vector of any one of clauses above, wherein the DNA binding protein comprises a sequence of: (i) SEQ ID NOs: 6-9, 13-15, 44-45, 48-49, 54-55, 58-62, 67-77, 103, 112, 114, 268-282, 305-325, 337-350, 364, 295-

299, or 365-366; (ii) a variant or functional fragment thereof; or (iii) a sequence having at least 90% sequence identity (or at least 91%, 92%, 93%, 94%, 95%, 96%, 97%, 98%, or 99% sequence identity) to any one of (i) or (ii).

61. The vector of any one of clauses 50-60, wherein the sequence identity refers to local sequence identity of a DNA binding domain in the DNA binding protein and that of EGR1 or EGR3.

62. The vector of clause 61, wherein the DNA binding protein comprises a transcription effector domain derived from CITED2 or CITED4.

63. The vector of any one of clauses 50-62, wherein the sequence identity refers to global sequence identity of the DNA binding protein as compared to human EGR1 or EGR3.

64. The vector of clause 63, wherein the DNA binding protein comprises a transcription effector domain derived from EGR1 or EGR3.

65. The vector of clause 62 or 64, wherein the effector domain is positioned at C-terminus of the DNA binding domain in the DNA binding protein.

66. The vector of clause 62 or 64, wherein the effector domain is positioned at N-terminus of the DNA binding domain in the DNA binding protein.

67. The vector of any one of clauses 50-66, wherein the DNA binding protein comprises a DNA binding domain having a sequence of: (i) SEQ ID NOs: 22-26, 29-32, 84-93, 112, 131-135, 165-171, 371-372, 376-409, or 412-416; (ii) a variant or functional fragment thereof; or (iii) a sequence having at least 90% sequence identity (or at least 91%, 92%, 93%, 94%, 95%, 96%, 97%, 98%, or 99% sequence identity) to any one of (i) or (ii).

68. The vector of clause any one of clauses 50-67, wherein the effector domain has a sequence of: (i) SEQ ID NOs: 95-100 or 114, (ii) a variant or functional fragment thereof or (iii) a sequence having at least 90% sequence identity (or at least 91%, 92%, 93%, 94%, 95%, 96%, 97%, 98%, or 99% sequence identity) to any one of (i) or (ii).

69. The vector of any one of clauses 50-68, wherein the zinc fingers comprise at least one amino acid substitution at position −1, 2, 3 or 6 of recognition helices of the zinc fingers.

70. The vector of any one of clauses 50-69, wherein the DNA binding protein has comparable immunogenicity as human EGR1 or ERG3, as measured by elispot assay (e.g., wherein comparable refers to a level within 1%, 2%, 3%, 4%, 5%, 6%, 7%, 8%, 9%, or 10% of the immune response generated by the naturally occurring human protein).

71. The vector of any one of clauses 50-70, wherein the sequence identity is measured using BLAST or ClustalW.

72. The vector of any one of clauses 70-72, wherein the vector is a viral vector.

73. The vector of clause 72, wherein the viral vector is AAV.

74. The vector of clause 73, wherein the AAV is AAV9.

75. A nucleic acid cassette encoding a non-naturally DNA binding protein having 90% or greater sequence identity to a naturally occurring human protein, or at least 80%, 81%, 82%, 83%, 84%, 85%, 86%, 87%, 88%, 89%, 90%, 91%, 92%, 93%, 94%, 95%, 96%, 97%, 98%, or 99% local sequence identity to a corresponding domain of a naturally occurring human protein (e.g., within a DNA binding domain or a transcription effector domain between the two proteins), or at least 90%, 91%, 92%, 93%, 94%, 95%, 96%, 97%, 98%, or 99% global sequence identity to a naturally occurring human protein (e.g., EGR1 or EGR3), wherein the DNA binding protein is capable of modulating expression of SCN1A.

76. The nucleic acid cassette of clause 75, wherein the non-naturally occurring DNA binding protein selectively binds to a region having any one of SEQ ID NOs: 35-38, 105-111, 113, 136, 195-211, 224-238, 240-267, or 330-336, or a region within 5 bp, 10 bp, 50 bp, 100 bp, 200 bp, or 500 bp thereof.

77. The nucleic acid cassette of any one of clauses 75-76, wherein the non-naturally occurring DNA binding protein is able to increase expression of SCN1A by a factor of at least 1.5, 2, 3, 4, 5, 6, 7, 8, 9, 10, 15, 20, 50, or 100 fold as compared to a control.

78. The nucleic acid cassette of any one of clauses 75-77, wherein the non-naturally occurring DNA binding protein comprises a DNA binding domain having a sequence of: (i) SEQ ID NOs: 22-26, 29-32, 84-93, 112, 131-135, 165-171, 371-372, 376-409, or 412-416; (ii) a variant or functional fragment thereof or (iii) a sequence having at least 90% sequence identity (or at least 91%, 92%, 93%, 94%, 95%, 96%, 97%, 98%, or 99% sequence identity) to any one of (i) or (ii).

79. The nucleic acid cassette of any one of clauses 75-78, wherein the cassette is a viral vector.

80. The nucleic acid cassette of any one of clauses 75-79, wherein the cassette is an AAV vector, such as AAV9.

81. A nucleic acid cassette encoding a non-naturally DNA binding protein having at least 80%, 81%, 82%, 83%, 84%, 85%, 86%, 87%, 88%, 89%, 90%, 91%, 92%, 93%, 94%, 95%, 96%, 97%, 98%, or 99% local sequence identity to a corresponding domain of a naturally occurring human protein (e.g., within a DNA binding domain or a transcription effector domain between the two proteins), or at least 90%, 91%, 92%, 93%, 94%, 95%, 96%, 97%, 98%, or 99% global sequence identity to a naturally occurring human protein (e.g., EGR1 or EGR3), wherein the DNA binding protein is capable of modulating expression of GRN.

82. The nucleic acid cassette of clause 81, wherein the non-naturally occurring DNA binding protein selectively binds to a region having SEQ ID NOs: 35-38, 105-111, 113, 136, 195-211, 224-238, 240-267, or 330-336, or a region within 5 bp, 10 bp, 50 bp, 100 bp, 200 bp, or 500 bp thereof.

83. The nucleic acid cassette of any one of clauses 81-82, wherein the non-naturally occurring DNA binding protein is able to increase expression of GRN by a factor of at least 1.5, 2, 3, 4, 5, 6, 7, 8, 9, 10, 15, 20, 25, 50, or 100 fold as compared to a control.

84. The nucleic acid cassette of any one of clauses 81-83, wherein the non-naturally occurring DNA binding protein comprises a DNA binding domain having a sequence of: (i) SEQ ID NOs: 22-26, 29-32, 84-93, 112, 131-135, 165-171, 371-372, 376-409, or 412-416; (ii) a variant or functional fragment thereof or (iii) a sequence having at least 90% sequence identity (or at least 91%, 92%, 93%, 94%, 95%, 96%, 97%, 98%, or 99% sequence identity) to any one of (i) or (ii).

85. The nucleic acid cassette of any one of clauses 81-84, wherein the DNA binding protein comprises a sequence of: (i) SEQ ID NOs: 6-9, 13-15, 44-45, 48-49, 54-55, 58-62, 67-77, 103, 112, 114, 268-282, 305-325, 337-

350, 364, 295-299, 365-366; (ii) a variant or functional fragment thereof; or (iii) a sequence having at least 90% sequence identity (or at least 91%, 92%, 93%, 94%, 95%, 96%, 97%, 98%, or 99% sequence identity) to any one of (i) or (ii).
86. The nucleic acid cassette of any one of clauses 81-85, wherein the cassette is a viral vector.
87. The nucleic acid cassette of any one of clauses 81-86, wherein the cassette is an AAV vector.
88. A vector that encodes a protein that modulates SCN1A, wherein the protein has an amino acid sequence of SEQ ID NOs: 6-9, 13, 15, 57, 58, 61-62, 67-71, 74-75, 268-282, 295-299, 305-325, or 364-366.
89. A vector that encodes a protein that modulates SCN1A, wherein the protein comprises a DNA binding domain having a sequence of SEQ ID NOs: 22-25, 29-31, 84-85, 88, 90-92, 131-135, 371-372, 376, or 391-409.
90. The vector of any one of clauses 88-89, wherein the protein recognizes a target binding sequence comprising a sequence of SEQ ID NOs: 35-37, 101, 105-111, 136, 195-211, 224-238, or 240-267.
91. A vector that encodes a protein that modulates GRN, wherein the protein has an amino acid sequence of SEQ ID NOs: 10, 16, 59-60, 63-64, 72-73, 76-77, 112, or 337-350.
92. A vector that encodes a protein that modulates GRN, wherein the protein comprises a DNA binding domain having a sequence of SEQ ID NOs: 26, 32, 86-89, 93, 165-171, 112, or 377-390.
93. The vector of any one of clauses 91-92, wherein the protein recognizes a target binding sequence comprising a sequence of SEQ ID NOs: 38, 113, or 330-336.
94. The vector of any one of clauses 91-93, wherein the DNA binding domain is fused to a transactivation domain of CITED2 or CITED4.
95. A method of treating a disease or condition, comprising contacting a cell or a subject with a composition comprising any one of clauses 1-94.
96. The method of clause 95, wherein the subject is an animal, mammal, or human.
97. A method of treating a disease or condition, comprising administering a gene therapy comprising a nucleic acid cassette encoding a non-naturally occurring DNA binding protein comprising a DNA binding domain, wherein the non-naturally occurring DNA binding protein modulates expression of an endogenous gene by a factor of at least 5-fold, and wherein the non-naturally occurring DNA binding protein has at least 80%, 81%, 82%, 83%, 84%, 85%, 86%, 87%, 88%, 89%, 90%, 91%, 92%, 93%, 94%, 95%, 96%, 97%, 98%, or 99% local sequence identity to a corresponding domain of a naturally occurring human protein (e.g., within a DNA binding domain or a transcription effector domain between the two proteins), or global sequence identity to a naturally occurring human protein (e.g., EGR1 or EGR3).
98. The method of clause 97, wherein the non-naturally occurring DNA binding protein elicits reduced or minimal immune response when expressed in a cell or in vivo.
99. The method of clause 98, wherein the non-naturally occurring DNA binding protein elicits an immune response that is comparable to a naturally occurring human protein, wherein comparable refers to a level within 1%, 2%, 3%, 4%, 5%, 6%, 7%, 8%, 9%, or 10% of the immune response generated by the naturally occurring human protein (e.g., EGR1 or EGR3).
100. The method of any one of clauses 92-99, wherein the immune response is measured using an elispot assay.
101. The method of any one of clauses 97-100, wherein the disease or condition is Dravet syndrome.
102. The method of any one of clauses 97-100, wherein the disease or condition is frontotemporal dementia or dementia.
103. The method of any one of clauses 97-100, wherein the disease or condition is selected from the group consisting of: Dravet syndrome, Parkinson's disease, Alzheimer's disease, GABAergic hypofunction, neuronal hyperactivity, epilepsy, and seizures.
104. The method of any one of clauses 97-100, wherein the disease or condition is selected from the group consisting of: neurodegeneration, neuroinflammation, frontotemporal lobar degeneration, frontotemporal dementia, dementia, Parkinson's disease, Alzheimer's disease, and atherosclerosis.
105. The method of any one of clauses 97-104, wherein the DNA binding protein has an amino acid sequence of SEQ ID NOs: 6-9, 13-15, 44-45, 48-49, 54-55, 58-62, 67-77, 103, 112, 114, 268-282, 305-325, 337-350, 364, 295-299, 365-366.
106. The method of any one of clauses 97-105, wherein the DNA binding protein has an amino acid sequence of SEQ ID NOs: 22-26, 29-32, 84-93, 112, 131-135, 165-171, 371-372, 376-409, or 412-416.
107. The method of any one of clauses above, wherein the DNA binding protein comprises a DNA binding domain having a sequence of SEQ ID NOs: 22-26, 29-32, 84-93, 112, 131-135, 165-171, 371-372, 376-409, or 412-416.
108. The method of any one of clauses 97-107, wherein the DNA binding protein recognizes a target binding sequence comprising a sequence of SEQ ID NOs: 35-38, 105-111, 113, 136, 195-211, 224-238, 240-267, or 330-336.
109. The method of any one of clauses above, wherein the endogenous gene is SCN1A or GRN.
110. The method of any one of clauses above, wherein the gene therapy is AAV.
111. A method of modulating expression of an endogenous gene, the method comprising administering a nucleic acid cassette encoding a non-naturally occurring DNA binding protein comprising a plurality of DNA binding domains that collectively bind a target binding site having at least 21 bases in a human genome and having at least 80%, 81%, 82%, 83%, 84%, 85%, 86%, 87%, 88%, 89%, 90%, 91%, 92%, 93%, 94%, 95%, 96%, 97%, 98%, or 99% local sequence identity to a corresponding domain of a naturally occurring human protein (e.g., within a DNA binding domain or a transcription effector domain between the two proteins), or global sequence identity to a naturally occurring human protein (e.g., EGR1 or EGR3).
112. The method of clause 111, wherein the naturally occurring protein is human EGR1 or EGR3.
113. The method of any one of clauses 111-112, wherein the DNA binding protein comprises a domain of CITED2 or CITED4.
114. A method of treating a disease or condition, the method comprising administering an AAV vector comprising a non-naturally occurring DNA binding protein having at least 80%, 81%, 82%, 83%, 84%, 85%, 86%, 87%, 88%, 89%, 90%, 91%, 92%, 93%, 94%, 95%, 96%, 97%, 98%, or 99% local sequence identity to a corresponding domain of a naturally occurring human protein (e.g., within a DNA binding domain or a transcription effector domain between the two proteins), or global sequence identity to a naturally occurring human protein (e.g., EGR1 or EGR3), and comprising at least 6, 7, 8, 9, 10, 11, or 12 zinc fingers or DNA binding domains.

115. The method of clause 114, wherein the human protein is EGR1 or EGR3.

116. The method of any one of clauses 114-115, wherein the disease or condition is a CNS disease or condition.

117. The method of clause 116, wherein the disease or condition is Dravet syndrome.

118. The method of clause 116, wherein the disease or condition is dementia or frontotemporal dementia.

119. The method of any one of clauses 114-115, wherein the sequence identity is measured using a Needleman-Wunsch algorithm for global sequence identity.

120. The method of any one of clauses above, wherein the sequence identity is measured using a Smith-Waterman algorithm for local sequence identity.

121. A method of treating Dravet syndrome, comprising administering a vector encoding a non-naturally occurring DNA binding protein having at least 80%, 81%, 82%, 83%, 84%, 85%, 86%, 87%, 88%, 89%, 90%, 91%, 92%, 93%, 94%, 95%, 96%, 97%, 98%, or 99% local sequence identity to a corresponding domain of a naturally occurring human protein (e.g., within a DNA binding domain or a transcription effector domain between the two proteins), or global sequence identity to a naturally occurring human protein (e.g., EGR1 or EGR3), wherein the DNA binding protein is capable of activating or increasing expression of endogenous SCN1A.

122. The method of clause 121, wherein the non-naturally occurring DNA binding protein selectively binds to a region having any one of SEQ ID NOs: 35-38, 105-111, 113, 136, 195-211, 224-238, 240-267, or 330-336, or a region within 5 bp, 10 bp, 50 bp, 100 bp, 200 bp, or 500 bp thereof.

123. The method of any one of clauses 121-122, wherein the non-naturally occurring DNA binding protein is able to increase expression of SCN1A by a factor of at least 1.5, 2, 3, 4, 5, 6, 7, 8, 9, 10, 15, 20, 25, 50, or 100 fold as compared to a control.

124. The method of any one of clauses 121-123, wherein the non-naturally occurring DNA binding protein comprises a DNA binding domain having a sequence of: (i) SEQ ID NOs: 22-26, 29-32, 84-93, 112, 131-135, 165-171, 371-372, 376-409, or 412-416; (ii) a variant or functional fragment thereof or (iii) a sequence having at least 90% sequence identity (or at least 91%, 92%, 93%, 94%, 95%, 96%, 97%, 98%, or 99% sequence identity) to any one of (i) or (ii).

125. The method of any one of clauses 121-124, wherein the vector is a viral vector.

126. The method of clause 125, wherein the vector is an AAV vector.

127. A method of treating frontotemporal dementia or dementia, comprising administering a vector encoding a non-naturally occurring DNA binding protein having at least 80%, 81%, 82%, 83%, 84%, 85%, 86%, 87%, 88%, 89%, 90%, 91%, 92%, 93%, 94%, 95%, 96%, 97%, 98%, or 99% local sequence identity to a corresponding domain of a naturally occurring human protein (e.g., within a DNA binding domain or a transcription effector domain between the two proteins), or global sequence identity to a naturally occurring human protein (e.g., EGR1 or EGR3), wherein the DNA binding protein is capable of activating or increasing expression of endogenous GRN or an isoform thereof.

128. The method of clause 127, wherein the non-naturally occurring DNA binding protein selectively binds to a region having SEQ ID NOs: 38, 113, or 330-336, or a region within 5 bp, 10 bp, 50 bp, 100 bp, 200 bp, or 500 bp thereof.

129. The method of any one of clauses 127-128, wherein the non-naturally occurring DNA binding protein is able to increase expression of GRN by a factor of at least 1.5, 2, 3, 4, 5, 6, 7, 8, 9, 10, 15, 20, 25, 50, or 100 fold as compared to a control.

130. The method of clause any one of clauses 127-129, wherein the non-naturally occurring DNA binding protein comprises a DNA binding domain having a sequence of: (i) SEQ ID NOs: 26, 32, 86-89, 93, 165-171, 165-171, or 377-390; (ii) a variant or functional fragment thereof; or (iii) a sequence having at least 90% sequence identity (or at least 91%, 92%, 93%, 94%, 95%, 96%, 97%, 98%, or 99% sequence identity) to any one of (i) or (ii).

131. The method of any one of clauses 127-130, wherein the DNA binding protein comprises a sequence of: (i) SEQ ID NOs: 10, 16, 59-60, 63-64, 72-73, 76, 77, 112, or 337-350; (ii) a variant or functional fragment thereof; or (iii) a sequence having at least 90% sequence identity (or at least 91%, 92%, 93%, 94%, 95%, 96%, 97%, 98%, or 99% sequence identity) to any one of (i) or (ii).

132. The method of any one of clauses 127-131, wherein the vector is a viral vector.

133. The method of clause 133, wherein the vector is an AAV vector.

Provided herein are expression cassettes comprising a non-naturally occurring transcriptional modulator, such as expression cassettes that increase expression of the SCN1A gene, and methods for using the same in the treatment of a condition associated with the SCN1A gene. Also provided herein are non-naturally occurring DNA binding proteins that modulate the expression of a neurological protein, such as SCN1A.

Various embodiments of this disclosure are defined with reference to the following numbered clauses:

1. An expression cassette, comprising a non-naturally occurring transcriptional modulator which increases expression of the SCN1A gene.

2. The expression cassette of clause 1, wherein the non-naturally occurring transcriptional modulator binds a genomic region selected from the group consisting of: SEQ ID NOs: 35-37, 101, 105-111, 136, 195-211, 224-238, or 240-267, or a region within at least 200 bp thereof.

3. The expression cassette of clause 1-2, wherein the non-naturally occurring transcriptional modulator binds a genomic region selected from the group consisting of: SEQ ID NOs: 35-37, 101, 105-111, 136, 195-211, 224-238, or 240-267, or a region within at least 100 bp thereof.

4. The expression cassette of clause 1-2, wherein the non-naturally occurring transcriptional modulator binds a genomic region selected from the group consisting of: SEQ ID NOs: 35-37, 101, 105-111, 136, 195-211, 224-238, or 240-267, or a region within at least 50 bp thereof.

5. The expression cassette of clause 1-2, wherein the non-naturally occurring transcriptional modulator binds a genomic region selected from the group consisting of: SEQ ID NOs: 35-37, 101, 105-111, 136, 195-211, 224-238, or 240-267, or a region within at least 10 bp thereof.
6. The expression cassette of clause 1-2, wherein the non-naturally occurring transcriptional modulator binds a genomic region corresponding to the region of hg19 which matches a sequence selected from the group consisting of: SEQ ID NOs: 35-37, 101, 105-111, 136, 195-211, 224-238, or 240-267.
7. The expression cassette of any one of the above clauses, wherein the expression cassette is a part of a viral vector.
8. The expression cassette of clause 6, wherein the viral vector is an AAV virus.
9. The expression cassette of clause 7, wherein the AAV virus is an AAV9 virus or a scAAV9 virus.
10. The expression cassette of any one of the above clauses, wherein the transcriptional modulator comprises a DNA binding domain and a transcription activating domain.
11. The expression cassette of any one of the above clauses, wherein the transcription activating domain comprises a part of at least one protein selected from the list consisting of: VPR, VP64, VP16, VP128, and p300.
12. The expression cassette of any one of the above clauses, wherein the transcription activating domain comprises 95-100 or 114, or a domain with at least 80% sequence similarity thereto.
13. The expression cassette of any one of the above clauses, wherein the DNA binding domain is a zinc finger domain.
14. The expression cassette of any one of the above clauses, wherein the DNA binding domain is a Cas protein.
15. The expression cassette of any one of the above clauses, wherein the expression cassette further comprises a gRNA.
16. The expression cassette of any one of the above clauses, wherein the gRNA comprises a sequence selected from the group consisting of: SEQ ID NOs: 35-38, 105-111, 113, 136, 195-211, 224-238, 240-267, or 330-336, or a sequence with at least 80% sequence similarity thereto.
17. The expression cassette of clause 16, wherein the gRNA comprises a sequence selected from the group consisting of: SEQ ID NOs: 35-38, 105-111, 113, 136, 195-211, 224-238, 240-267, or 330-336, or a sequence with at least 90% sequence similarity thereto, with at least 95% sequence similarity thereto, or with at least 99% sequence similarity thereto.
18. The expression cassette of any one of the above clauses, wherein the Cas protein is a nuclease-inactivated Cas protein.
19. The expression cassette of clause 18, wherein the nuclease-inactivated Cas protein is a nuclease-inactivated Cas9.
20. The expression cassette of clause 19, wherein the nuclease-inactivated Cas protein is a nuclease-inactivated Cas3.
21. The expression cassette of any one of claims clauses, wherein the DNA binding domain is a TAL effector DNA-binding domain.
22. The expression cassette of any one of the above clauses, wherein the expression cassette further comprises a regulatory element which drives expression of the non-naturally occurring transcriptional modulator at a higher level in GABAergic neurons than in other cell types.
23. The expression cassette of any one of the above clauses, wherein the expression cassette further comprises a regulatory element which is less than 100 bp and drives high expression of the non-naturally occurring transcriptional modulator.
24. The expression cassette of any one of the above clauses, wherein the expression cassette further comprises at least one regulatory element selected from the group consisting of: SEQ ID NOs: 178-179, 182-185, or 417, or a sequence with at least 80%, at least 90%, at least 95%, or at least 99% sequence identity thereto.
25. The expression cassette of any of the above clauses, wherein the non-naturally occurring transcriptional modulator is selected from the group consisting of SEQ ID NOs: 6-9, 13-15, 44-45, 48-49, 54-55, 58-62, 67-77, 103, 112, 114, 268-282, 305-325, 337-350, 364, 295-299, 365-366, or has at least 80%, at least 90%, at least 95%, or at least 99% sequence identity thereto.
26. The expression cassette of any of the clauses above, wherein the non-naturally occurring transcriptional modulator is selected from the group consisting of SEQ ID NOs: 22-26, 29-32, 84-93, 112, 131-135, 165-171, 371-372, 376-409, or 412-416.
27. A non-naturally occurring DNA binding protein which binds at least one genomic location selected from the group consisting of: SEQ ID NOs: 35-38, 105-111, 113, 136, 195-211, 224-238, 240-267, or 330-336, or a genomic location within 200 bp, within 100 bp, or within 50 bp thereof.
28. The non-naturally occurring DNA binding protein of any clause above, wherein the non-naturally occurring DNA binding protein binds at least one genomic location selected from the group consisting of: SEQ ID NOs: 35-38, 105-111, 113, 136, 195-211, 224-238, 240-267, or 330-336.
29. The non-naturally occurring DNA binding protein of any clause above, further comprising a transcription modulating domain.
30. The non-naturally occurring DNA binding protein of clause 29, wherein the transcription modulating domain is a transcription activating domain.
31. The non-naturally occurring DNA binding protein of clauses 29-30, wherein the transcription activating domain is a transcription activating domain of a transcription factor.
32. The non-naturally occurring DNA binding protein of clauses above, wherein the transcription activating domain comprises a transcription activating domain of a zinc finger transcription factor.
33. The non-naturally occurring DNA binding protein of any clause above, wherein the transcription activating domain comprises a part of at least one protein selected from the list consisting of: VPR, VP64, VP16, and VP128, or a protein homologous thereto.
34. The non-naturally occurring DNA binding protein of any clause above, wherein the transcription activating domain comprises any one of SEQ ID NOs: 95-100 or 114, or a domain with at least 80% sequence similarity thereto.
35. The non-naturally occurring DNA binding protein of any clause above, wherein the transcription activating domain comprises any one of SEQ ID NOs: 95-100 or 114, or a domain with at least 90%, at least 95%, or at least 99% sequence similarity thereto.
36. The non-naturally occurring DNA binding protein of any clause above, wherein the transcription modulating domain comprises a transcriptional co-activating protein, or a domain of a transcriptional co-activating domain.
37. The non-naturally occurring DNA binding protein of clause 36, wherein the transcriptional co-activating domain comprises all or a part of p300.
38. The non-naturally occurring DNA binding protein of any clause above, wherein the DNA binding protein comprises a zinc finger domain.
39. The non-naturally occurring DNA binding protein of any clause above, wherein the zinc finger domain comprises four zinc fingers.
40. The non-naturally occurring DNA binding protein of any clause above, wherein the zinc finger domain comprises five zinc fingers.
41. The non-naturally occurring DNA binding protein of any clause above, wherein the zinc finger domain comprises six zinc fingers.
42. The non-naturally occurring DNA binding protein of any clause above, wherein the zinc finger domain comprises seven zinc fingers.
43. The non-naturally occurring DNA binding protein of any clause above, wherein the zinc finger domain comprises eight zinc fingers.
44. The non-naturally occurring DNA binding protein of any clause above, wherein the zinc finger domain comprises nine zinc fingers.
45. The non-naturally occurring DNA binding protein of any clause above, wherein the DNA binding protein comprises a Cas protein.
46. The non-naturally occurring DNA binding protein of clause 45, wherein the Cas protein is a nuclease-inactivated Cas protein.
47. The non-naturally occurring DNA binding protein of clause 46, wherein the nuclease-inactivated Cas protein is a nuclease-inactivated Cas9.
48. The non-naturally occurring DNA binding protein of clause 46 wherein the nuclease-inactivated Cas protein is a nuclease-inactivated Cas3.
49. The non-naturally occurring DNA binding protein of any clause above, wherein the DNA binding protein comprises a TAL effector DNA-binding domain.
50. The non-naturally occurring DNA binding protein of any clause above, wherein the non-naturally occurring DNA binding protein is selected from the group consisting of SEQ ID NOs: 22-26, 29-32, 84-93, 112, 131-135, 165-171, 371-372, 376-409, or 412-416, or has at least 90%, at least 95%, or at least 99% sequence identity thereto.
51. The non-naturally occurring DNA binding protein of any clause above, wherein the non-naturally occurring DNA binding protein modulates expression of SCN1A when transfected into a cell.
52. A method of modulating expression of SCN1A in a cell by administering a non-naturally occurring transcriptional modulator binds at least one genomic location selected from the group consisting of: SEQ ID NOs: 35-37, 101, 105-111, 136, 195-211, 224-238, or 240-267, or a genomic location within at 200 bp, within 100 bp, or within 20 bp thereof.
53. The method of clause 52, wherein the non-naturally occurring transcriptional modulator binds at least one genomic location selected from the group consisting of: SEQ ID NOs: 35-37, 101, 105-111, 136, 195-211, 224-238, or 240-267.
54. The method of clause 52-53, wherein the non-naturally occurring transcriptional modulator binds a sequence selected from the group consisting of: SEQ ID NOs: 35-37, 101, 105-111, 136, 195-211, 224-238, or 240-267.
55. A method of modulating expression of SCN1A in a cell by administering an expression cassette encoding a non-naturally occurring transcriptional modulator.
56. The method of clause 55, wherein the expression cassette is a part of a viral vector.
57. The method of clause 56, wherein the viral vector is an AAV virus.
58. The method of clause 57 wherein the AAV virus is an AAV9 virus or a scAAV9 virus.
59. The method of any clause above, wherein the cell is a parvalbumin (PV) cell.
60. The method of any one of any clause above, wherein the cell is within an organism.
61. The method of clause 60, wherein the organism is a mammal.
62. The method of clause 60, wherein the organism is a human.
63. The method of clause 60, wherein modulating expression of SCN1A treats a disease or disorder.
64. The method of clause 60, wherein the disorder is a central nervous system disorder.
65. The method of clause 60, wherein the disorder is Parkinson's disease.
66. The method of clause 60, wherein the disorder is Dravet Syndrome.
67. The method of clause 60, wherein the disorder is Alzheimer's disease.
68. The method of clause 60, wherein a symptom of the central nervous system disorder is GABAergic hypofunction.
69. The method of any clause above, wherein treating the central nervous system disorder comprises increasing PV cell function.
70. The method of any clause above, wherein a symptom of the central nervous system disorder is neuronal hyperactivity.
71. The method of any clause above, wherein treating the central nervous system disorder comprises reducing neuronal hyperactivity.
72. The method of any clause above, wherein a symptom of the central nervous system disorder is seizures.
73. The method of any clause above, wherein treating the central nervous system disorder comprises reducing the frequency of seizures.
74. The method of any clause above, wherein treating the central nervous system disorder comprises reducing the severity of seizures.
75. The method of any clause above, wherein the transcriptional modulator comprises a DNA binding domain and a transcription activating domain.
76. The method of any clause above, wherein the transcription activating domain comprises a transcription activating domain of a transcription factor.
77. The method of any clause above, wherein the transcription activating domain comprises a transcription activating domain of a zinc finger transcription factor.

78. The method of any clause above, wherein the transcription activating domain comprises a part of at least one protein selected from the list consisting of: VPR, VP64, VP16, and VP128.
79. The method of any clause above, wherein the transcription activating domain comprises 95-100 or 114, or a domain with at least 80% sequence similarity thereto.
80. The method of any clause above, wherein the transcription activating domain comprises a transcriptional co-activating protein, or a domain of a transcriptional co-activating domain.
81. The method of any clause above, wherein the transcription activating domain comprises p300.
82. The method of any clause above, wherein the DNA binding domain is a zinc finger domain.
83. The method of any clause above, wherein the DNA binding domain is a Cas protein.
84. The method of any clause above, wherein the expression cassette further comprises a gRNA.
85. The method of any clause above, wherein the gRNA comprises a sequence selected from the group consisting of: SEQ ID NOs: 105-111 or 113, or a sequence with at least 80% sequence identity thereto.
86. The method of any clause above, wherein the Cas protein is a nuclease-inactivated Cas protein.
87. The method of any clause above, wherein the nuclease-inactivated Cas protein is a nuclease-inactivated Cas9.
88. The method of any clause above, wherein the nuclease-inactivated Cas protein is a nuclease-inactivated Cas3.
89. The method of any clause above, wherein the DNA binding domain is a TAL effector DNA-binding domain.
90. The method of any clause above, wherein the expression cassette further comprises a regulatory element specific for parvalbumin cells.
91. The method of any clause above, wherein the expression cassette further comprises a regulatory element which is less than 100 bp and drives high expression.
92. The method of any clause above, wherein the expression cassette further comprises at least one regulatory element selected from the group consisting of: SEQ ID NOs: 178-179, 182-185, or 417, or a sequence with at least 80% sequence identity thereto.
93. The method of any clause above, wherein modulating expression of SCN1A comprises increasing the expression of the SCN1A gene, or the Nav1.1 protein.
94. The method of any clause above, wherein the increase in expression of the SCN1A gene, or the Nav1.1 protein, occurs specifically in parvalbumin cells.
95. The method of any clause above, wherein the increase in expression of the SCN1A gene, or the Nav1.1 protein, occurs specifically in parvalbumin neurons.
96. The method of any one of clause above, wherein the non-naturally occurring transcriptional modulator is selected from the group consisting of SEQ ID NOs: 95-100 or 114, or has at least 80%, at least 90%, at least 95%, or at least 99% sequence identity thereto.

Provided herein are expression cassettes comprising a non-naturally occurring transcriptional modulator that increases the expression of progranulin (GRN) or a functional fragment or variant thereof, and methods for using such compositions in the treatment of a condition or disease associated with the GRN gene. Also provided herein are non-naturally occurring DNA binding proteins that modulate the expression of GRN in a cell Various embodiments of this disclosure are defined with reference to the following numbered clauses:

1. An expression cassette, comprising a non-naturally occurring transcriptional modulator which increases expression of the GRN gene.
2. The expression cassette of clause 1, wherein the non-naturally occurring transcriptional modulator binds a genomic region selected from the group consisting of: SEQ ID NOs: 38, 113, or 330-336, or a region within at least 200 bp, within at least 100 bp, within at least 50 bp, or within at least 10 bp thereof.
3. The expression cassette of any clause above, wherein the non-naturally occurring transcriptional modulator binds a genomic region corresponding to the region of hg19 which matches a sequence selected from the group consisting of: SEQ ID NOs: 38, 113, or 330-336.
4. The expression cassette of any clause above, wherein the expression cassette is a part of a viral vector.
5. The expression cassette of clause 4, wherein the viral vector is an AAV virus.
6. The expression cassette of clause 5, wherein the AAV virus is an AAV9 virus or a scAAV9 virus.
7. The expression cassette of any clause above, wherein the transcriptional modulator comprises a DNA binding domain and a transcriptional activation domain.
8. The expression cassette of any clause above, wherein the transcriptional activation domain comprises a part of at least one protein selected from the list consisting of: VPR, VP64, VP16, VP128, p65, and p300.
9. The expression cassette of any clause above, wherein the transcriptional activation domain comprises SEQ ID NO: 95-100 or 114, or a domain with at least 80% sequence similarity thereto.
10. The expression cassette of any clause above, wherein the DNA binding domain is a zinc finger domain.
11. The expression cassette of any clause above, wherein the DNA binding domain is a Cas protein.
12. The expression cassette of any clause above, wherein the expression cassette further comprises a gRNA.
13. The expression cassette of any clause above, wherein the gRNA comprises a sequence selected from the group consisting of: SEQ ID NO: 113, or a sequence with at least 80%, at least 90%, at least 95%, or at least 99% sequence similarity thereto.
14. The expression cassette of any clause above, wherein the Cas protein is a nuclease-inactivated Cas protein (dCas).
15. The expression cassette of any clause above, wherein the nuclease-inactivated Cas protein is a nuclease-inactivated Cas9 (dCas9) or dSaCas9.
16. The expression cassette of any clause above, wherein the DNA binding domain is a TAL effector DNA-binding domain.
17. The expression cassette of any clause above, wherein the expression cassette further comprises a regulatory element which drives expression of the non-naturally occurring transcriptional modulator at a higher level in cells selected from the group consisting of: central nervous system cells, frontal cortex cells, glial cells, microglial cells, and striatum cells than in other cell types.
18. The expression cassette of any clause above, wherein the expression cassette further comprises a regulatory element which is less than 100 bp or less than 50 bp and drives high expression of the non-naturally occurring transcriptional modulator.

19. The expression cassette of any clause above, wherein the expression cassette further comprises a sequence according to SEQ ID NO: 178-179, 182-185, or 417, or a sequence with at least 80%, at least 90%, at least 95%, or at least 99% sequence identity thereto.

20. The expression cassette of any clause above, wherein the non-naturally occurring transcriptional modulator is selected from the group consisting of SEQ ID NO: 10, 16, 59-60, 63-64, 72-73, 76-77, 112, or 337-335, or has at least 80%, at least 90%, at least 95%, or at least 99% sequence identity thereto.

21. A non-naturally occurring DNA binding protein which binds at least one genomic location selected from the group consisting of: SEQ ID NOs: 38, 113, or 330-336, or a genomic location within 200 bp, within 100 bp, or within 50 bp, or within 10 bp thereof.

22. The non-naturally occurring DNA binding protein of any clause above, wherein the non-naturally occurring DNA binding protein binds at least one genomic location selected from the group consisting of: SEQ ID NOs: 38, 113, or 330-336.

23. The non-naturally occurring DNA binding protein of any clause above, further comprising a transcription modulating domain.

24. The non-naturally occurring DNA binding protein of any clause above, wherein the transcription modulating domain is a transcriptional activation domain.

25. The non-naturally occurring DNA binding protein of any clause above, wherein the transcriptional activation domain is a transcriptional activation domain of a transcription factor.

26. The non-naturally occurring DNA binding protein of any clause above, wherein the transcriptional activation domain comprises a transcriptional activation domain of a zinc finger transcription factor.

27. The non-naturally occurring DNA binding protein of any clause above, wherein the transcriptional activation domain comprises a part of at least one protein selected from the list consisting of: VPR, VP64, VP16, and VP128, or a protein homologous thereto.

28. The non-naturally occurring DNA binding protein of any clause above, wherein the transcriptional activation domain comprises SEQ ID NO: 95-100 or 114, or a domain with at least 80%, at least 90%, at least 95%, or at least 99% sequence similarity thereto.

29. The non-naturally occurring DNA binding protein of any clause above, wherein the transcription modulating domain comprises a transcriptional co-activating protein, or a domain of a transcriptional co-activating domain.

30. The non-naturally occurring DNA binding protein of clause 29, wherein the transcriptional co-activating domain comprises all or a part of p300.

31. The non-naturally occurring DNA binding protein of any clause above, wherein the DNA binding protein comprises a zinc finger domain.

32. The non-naturally occurring DNA binding protein of any clause above, wherein the zinc finger domain comprises four zinc fingers.

33. The non-naturally occurring DNA binding protein of any clause above, wherein the zinc finger domain comprises five zinc fingers.

34. The non-naturally occurring DNA binding protein of any clause above, wherein the zinc finger domain comprises six zinc fingers.

35. The non-naturally occurring DNA binding protein of any clause above, wherein the zinc finger domain comprises seven zinc fingers.

36. The non-naturally occurring DNA binding protein of any clause above, wherein the zinc finger domain comprises eight zinc fingers.

37. The non-naturally occurring DNA binding protein of any clause above, wherein the zinc finger domain comprises nine zinc fingers.

38. The non-naturally occurring DNA binding protein of any clause above, wherein the DNA binding protein comprises a Cas protein.

39. The non-naturally occurring DNA binding protein of any clause above, wherein the Cas protein is a nuclease-inactivated Cas protein.

40. The non-naturally occurring DNA binding protein of any clause above, wherein the nuclease-inactivated Cas protein is a nuclease-inactivated Cas9.

41. The non-naturally occurring DNA binding protein of any clause above, wherein the DNA binding protein comprises a TAL effector DNA-binding domain.

42. The non-naturally occurring DNA binding protein of any clause above, wherein the non-naturally occurring DNA binding protein is selected from the group comprising SEQ ID NOs: 26, 32, 86-89, 93, 165-171, 112, or 377-390, or has at least 90%, at least 95%, or at least 99%, sequence identity thereto.

43. The non-naturally occurring DNA binding protein of any clause above, wherein the non-naturally occurring DNA binding protein modulates expression of GRN when transfected into a cell.

44. A method of modulating expression of GRN in a cell by administering a non-naturally occurring transcriptional modulator binds at least one genomic location selected from the group consisting of: SEQ ID NOs: 38, 113, or 330-336, or a genomic location within 200 bp, within 100 bp, or within 20 bp thereof.

45. The method of clause 44, wherein the non-naturally occurring transcriptional modulator binds a sequence consisting of: SEQ ID NOs: 38, 113, or 330-336.

46. A method of modulating expression of GRN in a cell by administering an expression cassette encoding a non-naturally occurring transcriptional modulator.

47. The method of clause 46, wherein the expression cassette is a part of a viral vector.

48. The method of clause 47, wherein the viral vector is an AAV virus.

49. The method of clause 48, wherein the AAV virus is an AAV9 virus or a scAAV9 virus.

50. The method of any clause above, wherein the cell is selected from the group consisting of: central nervous system cells, frontal cortex cells, glial cells, microglial cells, and striatum cells.

51. The method of any one clause above, wherein the cell is within an organism.

52. The method of clause 51, wherein the organism is a mammal.

53. The method of clause 52, wherein the organism is a human.

54. The method of any clause above, wherein modulating expression of GRN treats a disease or disorder.

55. The method of any clause above, wherein the disorder is a central nervous system disorder.

56. The method of any clause above, wherein the disorder is Frontotemporal degeneration (FTD).
57. The method of any clause above, wherein the disorder is Parkinson's disease.
58. The method of any clause above, wherein the disorder is Alzheimer's disease.
59. The method of any clause above, wherein the disorder is Atherosclerosis.
60. The method of any clause above, wherein a symptom of the central nervous system disorder is a presence of Lewy bodies.
61. The method of any clause above, wherein a symptom of the central nervous system disorder is haploinsufficiency of progranulin (GRN).
62. The method of any clause above, wherein a symptom of the central nervous system disorder is social deficit.
63. The method of any clause above, wherein a symptom of the central nervous system disorder is lysosomal abnormality.
64. The method of any clause above, wherein a symptom of the central nervous system disorder is memory loss.
65. The method of any clause above, wherein a symptom of the central nervous system disorder is loss of motor coordination.
66. The method of any clause above, wherein a symptom of the central nervous system disorder is muscular tremors.
67. The method of any clause above, wherein treating the central nervous system disorder comprises reducing the frequency of muscular tremors.
68. The method of any clause above, wherein treating the central nervous system disorder comprises reducing the severity of muscular tremors.
69. The method of any clause above, wherein the transcriptional modulator comprises a DNA binding domain and a transcriptional activation domain.
70. The method of any clause above, wherein the transcriptional activation domain comprises a transcriptional activation domain of a transcription factor.
71. The method of any clause above, wherein the transcriptional activation domain comprises a transcriptional activation domain of a zinc finger transcription factor.
72. The method of any clause above, wherein the transcriptional activation domain comprises a part of at least one protein selected from the list consisting of: VPR, VP64, VP16, and VP128.
73. The method of any clause above, wherein the transcriptional activation domain comprises SEQ ID NO: 95-100 or 114, or a domain with at least 80% sequence similarity thereto.
74. The method of any clause above, wherein the transcriptional activation domain comprises a transcriptional co-activating protein, or a domain of a transcriptional co-activating domain.
75. The method of any clause above, wherein the transcriptional activation domain comprises p300.
76. The method of any clause above, wherein the DNA binding domain is a zinc finger domain.
77. The method of any clause above, wherein the DNA binding domain is a Cas protein.
78. The method of any clause above, wherein the expression cassette further comprises a gRNA.
79. The method of any clause above, wherein the gRNA comprises a sequence selected from the group consisting of: SEQ ID NO: 113, or a sequence with at least 80% sequence identity thereto.
80. The method of any clause above, wherein the Cas protein is a nuclease-inactivated Cas protein.
81. The method of any clause above, wherein the nuclease-inactivated Cas protein is a nuclease-inactivated Cas9.
82. The method of any clause above, wherein the DNA binding domain is a TAL effector DNA binding domain.
83. The method of any clause above, wherein the expression cassette further comprises a non-cell specific regulatory element.
84. The method of any clause above, wherein the expression cassette further comprises a regulatory element which is less than 100 bp and drives high expression.
85. The method of any clause above, wherein the expression cassette further comprises a regulatory element comprising a sequence according to SEQ ID NO: 178-179, 182-185, or 417, or a sequence with at least 80% sequence identity thereto.
86. The method of any clause above, wherein modulating expression of GRN comprises increasing the expression of the GRN gene, or the progranulin protein.
87. The method of any clause above, wherein the increase in expression of the GRN gene, or the progranulin protein, occurs in a plurality of cell types.
88. The method of any clause above, wherein the increase in expression of the GRN gene, or the progranulin protein, occurs specifically in cells selected from the group consisting of: central nervous system cells, frontal cortex cells, glial cells, microglial cells, and Striatum cells than in other cell types.
89. The method of any clause above, wherein the non-naturally occurring transcriptional modulator is selected from the group consisting of SEQ ID NOs: 10, 16, 59-60, 72-72, 76-77, 112, or 337-350, or has at least 80%, at least 90%, at least 95%, or at least 99% sequence identity thereto.

SEQUENCE LISTING (454 sequences)

SEQ ID NO: 1 - protein, 543 aa, Artificial Sequence
  Description of Artificial Sequence: Synthetic polypeptide
MAAAKAEMQLMSPLQISDPFGSFPHSPTMDNYPKLEEMMLLSNGAPQFLGAAGAPEGSGSNSSSSSSGGGGGGGGGSNSSSSSSTFNPQADTGEQPYEHLTAESFPDISLNNEKVLVETSYPSQTTRLPPITYTGRFSLEPAPNSGNTLWPEPLFSLVSGLVSMTNPPASSSSAPSPAASSASASQSPPLSCAVPSNDSSPIYSAAPTFPTPNTDIFPEPQSQAFPGSAGTALQYPPPAYPAAKGGFQVPMIPDYLFPQQQGDLGLGTPDQKPFQGLESRTQQPSLTPLSTIKAFATQSGSQDLKALNTSYQSQLIKPSRMRKYPNRPSKTPPHERPYACPVESCDRRFSRSDELTRHIRIHTGQKPFQCRICMRNFSRSDHLTTHIRTHTGEKPFACDICGRKFARSDERKRHTKIHLRQKDKKADKSVVASSATSSLSSYPSPVATSYPSPVTTSYPSPATTSYPSPVPTSFSSPGSSTYPSPVHSGFPSPSVATTYSSVPPAFPAQVSSFPSSAVTNSFSASTGLSDMTATFSPRTIEIC

SEQ ID NO: 2 - protein, 631 aa, Artificial Sequence
  Description of Artificial Sequence: Synthetic polypeptide
MAAAKAEMQLMSPLQISDPFGSFPHSPTMDNYPKLEEMMLLSNGAPQFLGAAGAPEGSGSNSSSSSSGGGGGGGGGSNSSSSSSTFNPQADTGEQPYEHLTAESFPDISLNNEKVLVETSYPSQTTRLPPITYTGRFSLEPAPNSGNTLWPEPLFSLVSGLVSMTNPPASSSSAPSPAASSASASQSPPLSCAVPSNDSSPIYSAAPTFPTPNTDIFPEPQSQAFPGSAGTALQYPPPAYPAAKGGFQVPMIPDYLFPQQQGDLGLGTPDQKPFQGLESRTQQPSLTPLSTIKAFATQSGSQDLKALNTSYQSQLIKPSRMRKYPNRPSKTPPHELEPGEKPYKCPECGKSFSRRDELNVHQRTHTGEKPYKCPECGKSFSSRRTCRAHQRTHTGEKPYKCPECGKSFSQSSNLVRHQRTHTGEKPYKCPECGKSFSQLAHLRAHQRTHTGEKPYKCPECGKSFSTSGNLVRHQRTHTGEKPYKCPECGKSFSHRTTLTNHQRTHTGKKTSKKADKSVVASSATSSLSSYPSPVATSYPSPVTTSYPSPATTSYPSPVPTSFSSPGSSTYPSPVHSGFPSPSVATTYSSVPPAFPAQVSSFPSSAVTNSFSASTGLSDMTATFSPRTIEIC

SEQ ID NO: 3 - protein, 543 aa, Artificial Sequence
  Description of Artificial Sequence: Synthetic polypeptide
MAAAKAEMQLMSPLQISDPFGSFPHSPTMDNYPKLEEMMLLSNGAPQFLGAAGAPEGSGSNSSSSSSGGGGGGGGGSNSSSSSSTFNPQADTGEQPYEHLTAESFPDISLNNEKVLVETSYPSQTTRLPPITYTGRFSLEPAPNSGNTLWPEPLFSLVSGLVSMTNPPASSSSAPSPAASSASASQSPPLSCAVPSNDSSPIYSAAPTFPTPNTDIFPEPQSQAFPGSAGTALQYPPPAYPAAKGGFQVPMIPDYLFPQQQGDLGLGTPDQKPFQGLESRTQQPSLTPLSTIKAFATQSGSQDLKALNTSYQSQLIKPSRMRKYPNRPSKTPPHERPYACPVESCDRRFSQLAHLRAHIRIHTGQKPFQCRICMRNFSTSGNLVRHIRTHTGEKPFACDICGRKFAHRTTLTNHTKIHLRQKDKKADKSVVASSATSSLSSYPSPVATSYPSPVTTSYPSPATTSYPSPVPTSFSSPGSSTYPSPVHSGFPSPSVATTYSSVPPAFPAQVSSFPSSAVTNSFSASTGLSDMTATFSPRTIEIC

SEQ ID NO: 4 - protein, 631 aa, Artificial Sequence
  Description of Artificial Sequence: Synthetic polypeptide
MAAAKAEMQLMSPLQISDPFGSFPHSPTMDNYPKLEEMMLLSNGAPQFLGAAGAPEGSGSNSSSSSSGGGGGGGGGSNSSSSSSTFNPQADTGEQPYEHLTAESFPDISLNNEKVLVETSYPSQTTRLPPITYTGRFSLEPAPNSGNTLWPEPLFSLVSGLVSMTNPPASSSSAPSPAASSASASQSPPLSCAVPSNDSSPIYSAAPTFPTPNTDIFPEPQSQAFPGSAGTALQYPPPAYPAAKGGFQVPMIPDYLFPQQQGDLGLGTPDQKPFQGLESRTQQPSLTPLSTIKAFATQSGSQDLKALNTSYQSQLIKPSRMRKYPNRPSKTPPHERPYACPVESCDRRFSRRDELNVHIRIHTGQKPFQCRICMRNFSSRRTCRAHIRTHTGEKPFACDICGRKFAQSSNLVRHTKIHLRQKDRPYACPVESCDRRFSQLAHLRAHIRIHTGQKPFQCRICMRNFSTSGNLVRHIRTHTGEKPFACDICGRKFAHRTTLTNHTKIHLRQKDKKADKSVVASSATSSLSSYPSPVATSYPSPVTTSYPSPATTSYPSPVPTSFSSPGSSTYPSPVHSGFPSPSVATTYSSVPPAFPAQVSSFPSSAVTNSFSASTGLSDMTATFSPRTIEIC

SEQ ID NO: 5 - protein, 627 aa, Artificial Sequence
  Description of Artificial Sequence: Synthetic polypeptide
MAAAKAEMQLMSPLQISDPFGSFPHSPTMDNYPKLEEMMLLSNGAPQFLGAAGAPEGSGSNSSSSSSGGGGGGGGGSNSSSSSSTFNPQADTGEQPYEHLTAESFPDISLNNEKVLVETSYPSQTTRLPPITYTGRFSLEPAPNSGNTLWPEPLFSLVSGLVSMTNPPASSSSAPSPAASSASASQSPPLSCAVPSNDSSPIYSAAPTFPTPNTDIFPEPQSQAFPGSAGTALQYPPPAYPAAKGGFQVPMIPDYLFPQQQGDLGLGTPDQKPFQGLESRTQQPSLTPLSTIKAFATQSGSQDLKALNTSYQSQLIKPSRMRKYPNRPSKTPPHERPYACPVESCDRRFSRRDELNVHIRIHTGQKPFQCRICMRNFSSRRTCRAHIRTHTGEKPFACDICGRKFAQSSNLVRHIRTHTGEKPFACDICGRKFSQLAHLRAHIRIHTGQKPFQCRICMRNFSTSGNLVRHIRTHTGEKPFACDICGRKFAHRTTLTNHTKIHLRQKDKKADKSVVASSATSSLSSYPSPVATSYPSPVTTSYPSPATTSYPSPVPTSFSSPGSSTYPSPVHSGFPSPSVATTYSSVPPAFPAQVSSFPSSAVTNSFSASTGLSDMTATFSPRTIEIC

SEQ ID NO: 6 - protein, 631 aa, Artificial Sequence
  Description of Artificial Sequence: Synthetic polypeptide
MAAAKAEMQLMSPLQISDPFGSFPHSPTMDNYPKLEEMMLLSNGAPQFLGAAGAPEGSGSNSSSSSSGGGGGGGGGSNSSSSSSTFNPQADTGEQPYEHLTAESFPDISLNNEKVLVETSYPSQTTRLPPITYTGRFSLEPAPNSGNTLWPEPLFSLVSGLVSMTNPPASSSSAPSPAASSASASQSPPLSCAVPSNDSSPIYSAAPTFPTPNTDIFPEPQSQAFPGSAGTALQYPPPAYPAAKGGFQVPMIPDYLFPQQQGDLGLGTPDQKPFQGLESRTQQPSLTPLSTIKAFATQSGSQDLKALNTSYQSQLIKPSRMRKYPNRPSKTPPHERPYACPVESCDRRFSRSDNLVRHIRIHTGQKPFQCRICMRNFSREDNLHTHIRTHTGEKPFACDICGRKFARSDELVRHTKIHLRQKDRPYACPVESCDRRFSQSGNLTEHIRIHTGQKPFQCRICMRNFSTSGHLVRHIRTHTGEKPFACDICGRKFAQNSTLTEHTKIHLRQKDKKADKSVVASSATSSLSSYPSPVATSYPSPVTTSYPSPATTSYPSPVPTSFSSPGSSTYPSPVHSGFPSPSVATTYSSVPPAFPAQVSSFPSSAVTNSFSASTGLSDMTATFSPRTIEIC

SEQ ID NO: 7 - protein, 631 aa, Artificial Sequence
  Description of Artificial Sequence: Synthetic polypeptide
MAAAKAEMQLMSPLQISDPFGSFPHSPTMDNYPKLEEMMLLSNGAPQFLGAAGAPEGSGSNSSSSSSGGGGGGGGGSNSSSSSSTFNPQADTGEQPYEHLTAESFPDISLNNEKVLVETSYPSQTTRLPPITYTGRFSLEPAPNSGNTLWPEPLFSLVSGLVSMTNPPASSSSAPSPAASSASASQSPPLSCAVPSNDSSPIYSAAPTFPTPNTDIFPEPQSQAFPGSAGTALQYPPPAYPAAKGGFQVPMIPDYLFPQQQGDLGLGTPDQKPFQGLESRTQQPSLTPLSTIKAFATQSGSQDLKALNTSYQSQLIKPSRMRKYPNRPSKTPPHERPYACPVESCDRRFSRSDNLVRHIRIHTGQKPFQCRICMRNFSHRTTLTNHIRTHTGEKPFACDICGRKFAREDNLHTHTKIHLRQKDRPYACPVESCDRRFSTSHSLTEHIRIHTGQKPFQCRICMRNFSQSSSLVRHIRTHTGEKPFACDICGRKFAREDNLHTHTKIHLRQKDKKADKSVVASSATSSLSSYPSPVATSYPSPVTTSYPSPATTSYPSPVPTSFSSPGSSTYPSPVHSGFPSPSVATTYSSVPPAFPAQVSSFPSSAVTNSFSASTGLSDMTATFSPRTIEIC

SEQ ID NO: 8 - protein, 627 aa, Artificial Sequence
  Description of Artificial Sequence: Synthetic polypeptide
MAAAKAEMQLMSPLQISDPFGSFPHSPTMDNYPKLEEMMLLSNGAPQFLGAAGAPEGSGSNSSSSSSGGGGGGGGGSNSSSSSSTFNPQADTGEQPYEHLTAESFPDISLNNEKVLVETSYPSQTTRLPPITYTGRFSLEPAPNSGNTLWPEPLFSLVSGLVSMTNPPASSSSAPSPAASSASASQSPPLSCAVPSNDSSPIYSAAPTFPTPNTDIFPEPQSQAFPGSAGTALQYPPPAYPAAKGGFQVPMIPDYLFPQQQGDLGLGTPDQKPFQGLESRTQQPSLTPLSTIKAFATQSGSQDLKALNTSYQSQLIKPSRMRKYPNRPSKTPPHERPYACPVESCDRRFSRSDNLVRHIRIHTGQKPFQCRICMRNFSHRTTLTNHIRTHTGEKPFACDICGRKFAREDNLHTHIRTHTGEKPFACDICGRKFSTSHSLTEHIRIHTGQKPFQCRICMRNFSQSSSLVRHIRTHTGEKPFACDICGRKFAREDNLHTHTKIHLRQKDKKADKSVVASSATSSLSSYPSPVATSYPSPVTTSYPSPATTSYPSPVPTSFSSPGSSTYPSPVHSGFPSPSVATTYSSVPPAFPAQVSSFPSSAVTNSFSASTGLSDMTATFSPRTIEIC

SEQ ID NO: 9 - protein, 719 aa, Artificial Sequence
  Description of Artificial Sequence: Synthetic polypeptide
MAAAKAEMQLMSPLQISDPFGSFPHSPTMDNYPKLEEMMLLSNGAPQFLGAAGAPEGSGSNSSSSSSGGGGGGGGGSNSSSSSSTFNPQADTGEQPYEHLTAESFPDISLNNEKVLVETSYPSQTTRLPPITYTGRFSLEPAPNSGNTLWPEPLFSLVSGLVSMTNPPASSSSAPSPAASSASASQSPPLSCAVPSNDSSPIYSAAPTFPTPNTDIFPEPQSQAFPGSAGTALQYPPPAYPAAKGGFQVPMIPDYLFPQQQGDLGLGTPDQKPFQGLESRTQQPSLTPLSTIKAFATQSGSQDLKALNTSYQSQLIKPSRMRKYPNRPSKTPPHERPYACPVESCDRRFSRRDELNVHIRIHTGQKPFQCRICMRNFSRSDHLTNHIRTHTGEKPFACDICGRKFARSDDLVRHTKIHLRQKDRPYACPVESCDRRFSRSDNLVRHIRIHTGQKPFQCRICMRNFSHRTTLTNHIRTHTGEKPFACDICGRKFAREDNLHTHTKIHLRQKDRPYACPVESCDRRFSTSHSLTEHIRIHTGQKPFQCRICMRNFSQSSSLVRHIRTHTGEKPFACDICGRKFAREDNLHTHTKIHLRQKDKKADKSVVASSATSSLSSYPSPVATSYPSPVTTSYPSPATTSYPSPVPTSFSSPGSSTYPSPVHSGFPSPSVATTYSSVPPAFPAQVSSFPSSAVTNSFSASTGLSDMTATFSPRTIEIC

SEQ ID NO: 10 - protein, 631 aa, Artificial Sequence
  Description of Artificial Sequence: Synthetic polypeptide
MAAAKAEMQLMSPLQISDPFGSFPHSPTMDNYPKLEEMMLLSNGAPQFLGAAGAPEGSGSNSSSSSSGGGGGGGGGSNSSSSSSTFNPQADTGEQPYEHLTAESFPDISLNNEKVLVETSYPSQTTRLPPITYTGRFSLEPAPNSGNTLWPEPLFSLVSGLVSMTNPPASSSSAPSPAASSASASQSPPLSCAVPSNDSSPIYSAAPTFPTPNTDIFPEPQSQAFPGSAGTALQYPPPAYPAAKGGFQVPMIPDYLFPQQQGDLGLGTPDQKPFQGLESRTQQPSLTPLSTIKAFATQSGSQDLKALNTSYQSQLIKPSRMRKYPNRPSKTPPHERPYACPVESCDRRFSSPADLTRHIRIHTGQKPFQCRICMRNFSDSGNLRVHIRTHTGEKPFACDICGRKFAQLAHLRAHTKIHLRQKDRPYACPVESCDRRFSQRANLRAHIRIHTGQKPFQCRICMRNFSREDNLHTHIRTHTGEKPFACDICGRKFARSDNLVRHTKIHLRQKDKKADKSVVASSATSSLSSYPSPVATSYPSPVTTSYPSPATTSYPSPVPTSFSSPGSSTYPSPVHSGFPSPSVATTYSSVPPAFPAQVSSFPSSAVTNSFSASTGLSDMTATFSPRTIEIC

SEQ ID NO: 11 - protein, 387 aa, Artificial Sequence
  Description of Artificial Sequence: Synthetic polypeptide
MTGKLAEKLPVTMSSLLNQLPDNLYPEEIPSALNLFSGSSDSVVHYNQMATENVMDIGLTNEKPNPELSYSGSFQPAPGNKTVTYLGKFAFDSPSNWCQDNIISLMSAGILGVPPASGALSTQTSTASMVQPPQGDVEAMYPALPPYSNCGDLYSEPVSFHDPQGNPGLAYSPQDYQSAKPALDSNLFPMIPDYNLYHHPNDMGSIPEHKPFQGMDPIRVNPPPITPLETIKAFKDKQIHPGFGSLPQPPLTLKPIRPRKYPNRPSKTPLHERPHACPAEGCDRRFSQLAHLRAHLRIHTGHKPFQCRICMRSFSTSGNLVRHIRTHTGEKPFACEFCGRKFAHRTTLTNHAKIHLKQKEKKAEKGGAPSASSAPPVSLAPVVTTCA

SEQ ID NO: 12 - protein, 473 aa, Artificial Sequence
  Description of Artificial Sequence: Synthetic polypeptide
MTGKLAEKLPVTMSSLLNQLPDNLYPEEIPSALNLFSGSSDSVVHYNQMATENVMDIGLTNEKPNPELSYSGSFQPAPGNKTVTYLGKFAFDSPSNWCQDNIISLMSAGILGVPPASGALSTQTSTASMVQPPQGDVEAMYPALPPYSNCGDLYSEPVSFHDPQGNPGLAYSPQDYQSAKPALDSNLFPMIPDYNLYHHPNDMGSIPEHKPFQGMDPIRVNPPPITPLETIKAFKDKQIHPGFGSLPQPPLTLKPIRPRKYPNRPSKTPLHERPHACPAEGCDRRFSRRDELNVHLRIHTGHKPFQCRICMRSFSSRRTCRAHIRTHTGEKPFACEFCGRKFAQSSNLVRHAKIHLKQKEHACPAEGCDRRFSQLAHLRAHLRIHTGHKPFQCRICMRSFSTSGNLVRHIRTHTGEKPFACEFCGRKFAHRTTLTNHAKIHLKQKEKKAEKGGAPSASSAPPVSLAPVVTTCA

SEQ ID NO: 13 - protein, 473 aa, Artificial Sequence
  Description of Artificial Sequence: Synthetic polypeptide
MTGKLAEKLPVTMSSLLNQLPDNLYPEEIPSALNLFSGSSDSVVHYNQMATENVMDIGLTNEKPNPELSYSGSFQPAPGNKTVTYLGKFAFDSPSNWCQDNIISLMSAGILGVPPASGALSTQTSTASMVQPPQGDVEAMYPALPPYSNCGDLYSEPVSFHDPQGNPGLAYSPQDYQSAKPALDSNLFPMIPDYNLYHHPNDMGSIPEHKPFQGMDPIRVNPPPITPLETIKAFKDKQIHPGFGSLPQPPLTLKPIRPRKYPNRPSKTPLHERPHACPAEGCDRRFSRSDNLVRHLRIHTGHKPFQCRICMRSFSREDNLHTHIRTHTGEKPFACEFCGRKFARSDELVRHAKIHLKQKEHACPAEGCDRRFSQSGNLTEHLRIHTGHKPFQCRICMRSFSTSGHLVRHIRTHTGEKPFACEFCGRKFAQNSTLTEHAKIHLKQKEKKAEKGGAPSASSAPPVSLAPVVTTCA

SEQ ID NO: 14 - protein, 473 aa, Artificial Sequence
  Description of Artificial Sequence: Synthetic polypeptide
MTGKLAEKLPVTMSSLLNQLPDNLYPEEIPSALNLFSGSSDSVVHYNQMATENVMDIGLTNEKPNPELSYSGSFQPAPGNKTVTYLGKFAFDSPSNWCQDNIISLMSAGILGVPPASGALSTQTSTASMVQPPQGDVEAMYPALPPYSNCGDLYSEPVSFHDPQGNPGLAYSPQDYQSAKPALDSNLFPMIPDYNLYHHPNDMGSIPEHKPFQGMDPIRVNPPPITPLETIKAFKDKQIHPGFGSLPQPPLTLKPIRPRKYPNRPSKTPLHERPHACPAEGCDRRFSRSDNLVRHLRIHTGHKPFQCRICMRSFSHRTTLTNHIRTHTGEKPFACEFCGRKFAREDNLHTHAKIHLKQKEHACPAEGCDRRFSTSHSLTEHLRIHTGHKPFQCRICMRSFSQSSSLVRHIRTHTGEKPFACEFCGRKFAREDNLHTHAKIHLKQKEKKAEKGGAPSASSAPPVSLAPVVTTCA

SEQ ID NO: 15 - protein, 559 aa, Artificial Sequence
  Description of Artificial Sequence: Synthetic polypeptide
MTGKLAEKLPVTMSSLLNQLPDNLYPEEIPSALNLFSGSSDSVVHYNQMATENVMDIGLTNEKPNPELSYSGSFQPAPGNKTVTYLGKFAFDSPSNWCQDNIISLMSAGILGVPPASGALSTQTSTASMVQPPQGDVEAMYPALPPYSNCGDLYSEPVSFHDPQGNPGLAYSPQDYQSAKPALDSNLFPMIPDYNLYHHPNDMGSIPEHKPFQGMDPIRVNPPPITPLETIKAFKDKQIHPGFGSLPQPPLTLKPIRPRKYPNRPSKTPLHERPHACPAEGCDRRFSRRDELNVHLRIHTGHKPFQCRICMRSFSRSDHLTNHIRTHTGEKPFACEFCGRKFARSDDLVRHAKIHLKQKEHACPAEGCDRRFSRSDNLVRHLRIHTGHKPFQCRICMRSFSHRTTLTNHIRTHTGEKPFACEFCGRKFAREDNLHTHAKIHLKQKEHACPAEGCDRRFSTSHSLTEHLRIHTGHKPFQCRICMRSFSQSSSLVRHIRTHTGEKPFACEFCGRKFAREDNLHTHAKIHLKQKEKKAEKGGAPSASSAPPVSLAPVVTTCA

SEQ ID NO: 16 - protein, 473 aa, Artificial Sequence
  Description of Artificial Sequence: Synthetic polypeptide
MTGKLAEKLPVTMSSLLNQLPDNLYPEEIPSALNLFSGSSDSVVHYNQMATENVMDIGLTNEKPNPELSYSGSFQPAPGNKTVTYLGKFAFDSPSNWCQDNIISLMSAGILGVPPASGALSTQTSTASMVQPPQGDVEAMYPALPPYSNCGDLYSEPVSFHDPQGNPGLAYSPQDYQSAKPALDSNLFPMIPDYNLYHHPNDMGSIPEHKPFQGMDPIRVNPPPITPLETIKAFKDKQIHPGFGSLPQPPLTLKPIRPRKYPNRPSKTPLHERPHACPAEGCDRRFSSPADLTRHLRIHTGHKPFQCRICMRSFSDSGNLRVHIRTHTGEKPFACEFCGRKFAQLAHLRAHAKIHLKQKEHACPAEGCDRRFSQRANLRAHLRIHTGHKPFQCRICMRSFSREDNLHTHIRTHTGEKPFACEFCGRKFARSDNLVRHAKIHLKQKEKKAEKGGAPSASSAPPVSLAPVVTTCA

SEQ ID NO: 17 - protein, 88 aa, Artificial Sequence
  Description of Artificial Sequence: Synthetic polypeptide
RPYACPVESCDRRFSRSDELTRHIRIHTGQKPFQCRICMRNFSRSDHLTTHIRTHTGEKPFACDICGRKFARSDERKRHTKIHLRQKD

SEQ ID NO: 18 - protein, 176 aa, Artificial Sequence
  Description of Artificial Sequence: Synthetic polypeptide
LEPGEKPYKCPECGKSFSRRDELNVHQRTHTGEKPYKCPECGKSFSSRRTCRAHQRTHTGEKPYKCPECGKSFSQSSNLVRHQRTHTGEKPYKCPECGKSFSQLAHLRAHQRTHTGEKPYKCPECGKSFSTSGNLVRHQRTHTGEKPYKCPECGKSFSHRTTLTNHQRTHTGKKTS

SEQ ID NO: 19 - protein, 88 aa, Artificial Sequence
  Description of Artificial Sequence: Synthetic polypeptide
RPYACPVESCDRRFSQLAHLRAHIRIHTGQKPFQCRICMRNFSTSGNLVRHIRTHTGEKPFACDICGRKFAHRTTLTNHTKIHLRQKD

SEQ ID NO: 20 - protein, 176 aa, Artificial Sequence
  Description of Artificial Sequence: Synthetic polypeptide
RPYACPVESCDRRFSRRDELNVHIRIHTGQKPFQCRICMRNFSSRRTCRAHIRTHTGEKPFACDICGRKFAQSSNLVRHTKIHLRQKDRPYACPVESCDRRFSQLAHLRAHIRIHTGQKPFQCRICMRNFSTSGNLVRHIRTHTGEKPFACDICGRKFAHRTTLTNHTKIHLRQKD

SEQ ID NO: 21 - protein, 172 aa, Artificial Sequence
  Description of Artificial Sequence: Synthetic polypeptide
RPYACPVESCDRRFSRRDELNVHIRIHTGQKPFQCRICMRNFSSRRTCRAHIRTHTGEKPFACDICGRKFAQSSNLVRHIRTHTGEKPFACDICGRKFSQLAHLRAHIRIHTGQKPFQCRICMRNFSTSGNLVRHIRTHTGEKPFACDICGRKFAHRTTLTNHTKIHLRQKD

SEQ ID NO: 22 - protein, 176 aa, Artificial Sequence
  Description of Artificial Sequence: Synthetic polypeptide
RPYACPVESCDRRFSRSDNLVRHIRIHTGQKPFQCRICMRNFSREDNLHTHIRTHTGEKPFACDICGRKFARSDELVRHTKIHLRQKDRPYACPVESCDRRFSQSGNLTEHIRIHTGQKPFQCRICMRNFSTSGHLVRHIRTHTGEKPFACDICGRKFAQNSTLTEHTKIHLRQKD

SEQ ID NO: 23 - protein, 176 aa, Artificial Sequence
  Description of Artificial Sequence: Synthetic polypeptide
RPYACPVESCDRRFSRSDNLVRHIRIHTGQKPFQCRICMRNFSHRTTLTNHIRTHTGEKPFACDICGRKFAREDNLHTHTKIHLRQKDRPYACPVESCDRRFSTSHSLTEHIRIHTGQKPFQCRICMRNFSQSSSLVRHIRTHTGEKPFACDICGRKFAREDNLHTHTKIHLRQKD

SEQ ID NO: 24 - protein, 172 aa, Artificial Sequence
  Description of Artificial Sequence: Synthetic polypeptide
RPYACPVESCDRRFSRSDNLVRHIRIHTGQKPFQCRICMRNFSHRTTLTNHIRTHTGEKPFACDICGRKFAREDNLHTHIRTHTGEKPFACDICGRKFSTSHSLTEHIRIHTGQKPFQCRICMRNFSQSSSLVRHIRTHTGEKPFACDICGRKFAREDNLHTHTKIHLRQKD

SEQ ID NO: 25 - protein, 264 aa, Artificial Sequence
  Description of Artificial Sequence: Synthetic polypeptide
RPYACPVESCDRRFSRRDELNVHIRIHTGQKPFQCRICMRNFSRSDHLTNHIRTHTGEKPFACDICGRKFARSDDLVRHTKIHLRQKDRPYACPVESCDRRFSRSDNLVRHIRIHTGQKPFQCRICMRNFSHRTTLTNHIRTHTGEKPFACDICGRKFAREDNLHTHTKIHLRQKDRPYACPVESCDRRFSTSHSLTEHIRIHTGQKPFQCRICMRNFSQSSSLVRHIRTHTGEKPFACDICGRKFAREDNLHTHTKIHLRQKD

SEQ ID NO: 26 - protein, 176 aa, Artificial Sequence
  Description of Artificial Sequence: Synthetic polypeptide
RPYACPVESCDRRFSSPADLTRHIRIHTGQKPFQCRICMRNFSDSGNLRVHIRTHTGEKPFACDICGRKFAQLAHLRAHTKIHLRQKDRPYACPVESCDRRFSQRANLRAHIRIHTGQKPFQCRICMRNFSREDNLHTHIRTHTGEKPFACDICGRKFARSDNLVRHTKIHLRQKD

SEQ ID NO: 27 - protein, 87 aa, Artificial Sequence
  Description of Artificial Sequence: Synthetic polypeptide
PHACPAEGCDRRFSQLAHLRAHLRIHTGHKPFQCRICMRSFSTSGNLVRHIRTHTGEKPFACEFCGRKFAHRTTLTNHAKIHLKQKE

SEQ ID NO: 28 - protein, 172 aa, Artificial Sequence
  Description of Artificial Sequence: Synthetic polypeptide
HACPAEGCDRRFSRRDELNVHLRIHTGHKPFQCRICMRSFSSRRTCRAHIRTHTGEKPFACEFCGRKFAQSSNLVRHAKIHLKQKEHACPAEGCDRRFSQLAHLRAHLRIHTGHKPFQCRICMRSFSTSGNLVRHIRTHTGEKPFACEFCGRKFAHRTTLTNHAKIHLKQKE

SEQ ID NO: 29 - protein, 173 aa, Artificial Sequence
  Description of Artificial Sequence: Synthetic polypeptide
PHACPAEGCDRRFSRSDNLVRHLRIHTGHKPFQCRICMRSFSREDNLHTHIRTHTGEKPFACEFCGRKFARSDELVRHAKIHLKQKEHACPAEGCDRRFSQSGNLTEHLRIHTGHKPFQCRICMRSFSTSGHLVRHIRTHTGEKPFACEFCGRKFAQNSTLTEHAKIHLKQKE

SEQ ID NO: 30 - protein, 173 aa, Artificial Sequence
  Description of Artificial Sequence: Synthetic polypeptide
PHACPAEGCDRRFSRSDNLVRHLRIHTGHKPFQCRICMRSFSHRTTLTNHIRTHTGEKPFACEFCGRKFAREDNLHTHAKIHLKQKEHACPAEGCDRRFSTSHSLTEHLRIHTGHKPFQCRICMRSFSQSSSLVRHIRTHTGEKPFACEFCGRKFAREDNLHTHAKIHLKQKE

SEQ ID NO: 31 - protein, 259 aa, Artificial Sequence
  Description of Artificial Sequence: Synthetic polypeptide
PHACPAEGCDRRFSRRDELNVHLRIHTGHKPFQCRICMRSFSRSDHLTNHIRTHTGEKPFACEFCGRKFARSDDLVRHAKIHLKQKEHACPAEGCDRRFSRSDNLVRHLRIHTGHKPFQCRICMRSFSHRTTLTNHIRTHTGEKPFACEFCGRKFAREDNLHTHAKIHLKQKEHACPAEGCDRRFSTSHSLTEHLRIHTGHKPFQCRICMRSFSQSSSLVRHIRTHTGEKPFACEFCGRKFAREDNLHTHAKIHLKQKE

SEQ ID NO: 32 - protein, 173 aa, Artificial Sequence
  Description of Artificial Sequence: Synthetic polypeptide
PHACPAEGCDRRFSSPADLTRHLRIHTGHKPFQCRICMRSFSDSGNLRVHIRTHTGEKPFACEFCGRKFAQLAHLRAHAKIHLKQKEHACPAEGCDRRFSQRANLRAHLRIHTGHKPFQCRICMRSFSREDNLHTHIRTHTGEKPFACEFCGRKFARSDNLVRHAKIHLKQKE

SEQ ID NO: 33 - DNA, 18 bp, Homo sapiens
agtgatagagaacgtatg

SEQ ID NO: 34 - DNA, 9 bp, Homo sapiens
agtgataga

SEQ ID NO: 35 - DNA, 18 bp, Homo sapiens
ctaggtcaagtgtaggag

SEQ ID NO: 36 - DNA, 18 bp, Homo sapiens
taggtaccatagagtgag

SEQ ID NO: 37 - DNA, 27 bp, Homo sapiens
taggtaccatagagtgaggcgaggatg

SEQ ID NO: 38 - DNA, 18 bp, Homo sapiens
gagtagaaaagaaacaca

SEQ ID NO: 39 - protein, 7 aa, Artificial Sequence
  Description of Artificial Sequence: Synthetic peptide
  MOD_RES (2)..(2): Any amino acid
  MOD_RES (4)..(4): Any amino acid
  MOD_RES (6)..(6): Any amino acid
CXCXHXH

SEQ ID NO: 40 - protein, 17 aa, Artificial Sequence
  Description of Artificial Sequence: Synthetic peptide
  MOD_RES (2)..(2): Any amino acid
  MOD_RES (4)..(4): Any amino acid
  MOD_RES (6)..(6): Any amino acid
  MOD_RES (8)..(10): Any amino acid
  MOD_RES (12)..(12): Any amino acid
  MOD_RES (14)..(14): Any amino acid
  MOD_RES (16)..(16): Any amino acid
CXCXCXHXXXCXCXCXC

SEQ ID NO: 41 - protein, 17 aa, Artificial Sequence
  Description of Artificial Sequence: Synthetic peptide
  MOD_RES (2)..(2): Any amino acid
  MOD_RES (4)..(4): Any amino acid
  MOD_RES (6)..(6): Any amino acid
  MOD_RES (8)..(10): Any amino acid
  MOD_RES (12)..(12): Any amino acid
  MOD_RES (14)..(14): Any amino acid
  MOD_RES (16)..(16): Any amino acid
CXCXCXCXXXHXCXCXC

SEQ ID NO: 42 - protein, 15 aa, Artificial Sequence
  Description of Artificial Sequence: Synthetic peptide
  MOD_RES (2)..(2): Any amino acid
  MOD_RES (4)..(4): Any amino acid
  MOD_RES (6)..(6): Any amino acid
  MOD_RES (8)..(8): Any amino acid
  MOD_RES (10)..(10): Any amino acid
  MOD_RES (12)..(12): Any amino acid
  MOD_RES (14)..(14): Any amino acid
  MOD_RES (15)..(15): Cys, His, or Asp
CXCXHXCXCXCXCXX

SEQ ID NO: 43 - protein, 17 aa, Artificial Sequence
  Description of Artificial Sequence: Synthetic peptide
  MOD_RES (2)..(2): Any amino acid
  MOD_RES (4)..(4): Any amino acid
  MOD_RES (6)..(6): Any amino acid
  MOD_RES (8)..(10): Any amino acid
  MOD_RES (12)..(12): Any amino acid
  MOD_RES (14)..(14): Any amino acid
  MOD_RES (16)..(16): Any amino acid
CXCXCXCXXXCXCXCXC

SEQ ID NO: 44 - protein, 7 aa, Artificial Sequence
  Description of Artificial Sequence: Synthetic peptide
  MOD_RES (2)..(2): Any amino acid
  MOD_RES (4)..(4): Any amino acid
  MOD_RES (6)..(6): Any amino acid
CXCXCXH

SEQ ID NO: 45 - protein, 7 aa, Artificial Sequence
  Description of Artificial Sequence: Synthetic peptide
  MOD_RES (2)..(2): Any amino acid
  MOD_RES (4)..(4): Any amino acid
  MOD_RES (6)..(6): Any amino acid
CXCXHXC

SEQ ID NO: 46 - protein, 17 aa, Artificial Sequence
  Description of Artificial Sequence: Synthetic peptide
  MOD_RES (2)..(2): Any amino acid
  MOD_RES (4)..(4): Any amino acid
  MOD_RES (6)..(6): Any amino acid
  MOD_RES (8)..(10): Any amino acid
  MOD_RES (12)..(12): Any amino acid
  MOD_RES (14)..(14): Any amino acid
  MOD_RES (16)..(16): Any amino acid
CXCXHXCXXXCXCXHXC

SEQ ID NO: 47 - protein, 17 aa, Artificial Sequence
  Description of Artificial Sequence: Synthetic peptide
  MOD_RES (2)..(2): Any amino acid
  MOD_RES (4)..(4): Any amino acid
  MOD_RES (6)..(6): Any amino acid
  MOD_RES (8)..(10): Any amino acid
  MOD_RES (12)..(12): Any amino acid
  MOD_RES (14)..(14): Any amino acid
  MOD_RES (16)..(16): Any amino acid
CXCXCXCXXXCXCXHXC

SEQ ID NO: 48 - protein, 7 aa, Artificial Sequence
  Description of Artificial Sequence: Synthetic peptide
  MOD_RES (2)..(2): Any amino acid
  MOD_RES (4)..(4): Any amino acid
  MOD_RES (6)..(6): Any amino acid
CXCXCXC

SEQ ID NO: 49 - protein, 17 aa, Artificial Sequence
  Description of Artificial Sequence: Synthetic peptide
  MOD_RES (2)..(2): Any amino acid
  MOD_RES (4)..(4): Any amino acid
  MOD_RES (6)..(6): Any amino acid
  MOD_RES (8)..(10): Any amino acid
  MOD_RES (12)..(12): Any amino acid
  MOD_RES (14)..(14): Any amino acid
  MOD_RES (16)..(16): Any amino acid
CXCXCXCXXXCXHXHXC

SEQ ID NO: 50 - protein, 220 aa, Artificial Sequence
  Description of Artificial Sequence: Synthetic polypeptide
MAPKKKRKVGIHGVPAALEPGEKPYKCPECGKSFSRRDELNVHQRTHTGEKPYKCPECGKSFSSRRTCRAHQRTHTGEKPYKCPECGKSFSQSSNLVRHQRTHTGEKPYKCPECGKSFSQLAHLRAHQRTHTGEKPYKCPECGKSFSTSGNLVRHQRTHTGEKPYKCPECGKSFSHRTTLTNHQRTHTGKKTSKRPAATKKAGQAKKKKGSYPYDVPDYA

SEQ ID NO: 51 - protein, 272 aa, Artificial Sequence
  Description of Artificial Sequence: Synthetic polypeptide
MAPKKKRKVGIHGVPAALEPGEKPYKCPECGKSFSRRDELNVHQRTHTGEKPYKCPECGKSFSSRRTCRAHQRTHTGEKPYKCPECGKSFSQSSNLVRHQRTHTGEKPYKCPECGKSFSQLAHLRAHQRTHTGEKPYKCPECGKSFSTSGNLVRHQRTHTGEKPYKCPECGKSFSHRTTLTNHQRTHTGKKTSKRPAATKKAGQAKKKKGSYPYDVPDYALEDALDDFDLDMLGSDALDDFDLDMLGSDALDDFDLDMLGSDALDDFDLDML

SEQ ID NO: 52 - protein, 497 aa, Artificial Sequence
  Description of Artificial Sequence: Synthetic polypeptide
MAPKKKRKVGIHGVPAALEPGEKPYKCPECGKSFSRRDELNVHQRTHTGEKPYKCPECGKSFSSRRTCRAHQRTHTGEKPYKCPECGKSFSQSSNLVRHQRTHTGEKPYKCPECGKSFSQLAHLRAHQRTHTGEKPYKCPECGKSFSTSGNLVRHQRTHTGEKPYKCPECGKSFSHRTTLTNHQRTHTGKKTSKRPAATKKAGQAKKKKGSYPYDVPDYALEMSGLEMADHMMAMNHGRFPDGTNGLHHHPAHRMGMGQFPSPHHHQQQQPQHAFNALMGEHIHYGAGNMNATSGIRHAMGPGTVNGGHPPSALAPAARFNNSQFMGPPVASQGGSLPASMQLQKLNNQYFNHHPYPHNHYMPDLHPAAGHQMNGTNQHFRDCNPKHSGGSSTPGGSGGSSTPGGSGSSSGGGAGSSNSGGGSGSGNMPASVAHVPAAMLPPNVIDTDFIDEEVLMSLVIEMGLDRIKELPELWLGQNEFDFMTDFVCKQQPSRVSC

SEQ ID NO: 53 - protein, 406 aa, Artificial Sequence
  Description of Artificial Sequence: Synthetic polypeptide
MAPKKKRKVGIHGVPAALEPGEKPYKCPECGKSFSRRDELNVHQRTHTGEKPYKCPECGKSFSSRRTCRAHQRTHTGEKPYKCPECGKSFSQSSNLVRHQRTHTGEKPYKCPECGKSFSQLAHLRAHQRTHTGEKPYKCPECGKSFSTSGNLVRHQRTHTGEKPYKCPECGKSFSHRTTLTNHQRTHTGKKTSKRPAATKKAGQAKKKKGSYPYDVPDYALEMADHLMLAEGYRLVQRPPSAAAAHGPHALRTLPPYAGPGLDSGLRPRGAPLGPPPPRQPGALAYGAFGPPSSFQPFPAVPPPAAGIAHLQPVATPYPGRAAAPPNAPGGPPGPQPAPSAAAPPPPAHALGGMDAELIDEEALTSLELELGLHRVRELPELFLGQSEFDCFSDLGSAPPAGSVSC

SEQ ID NO: 54 - protein, 597 aa, Artificial Sequence
  Description of Artificial Sequence: Synthetic polypeptide
MAADHLMLAEGYRLVQRPPSAAAAHGPHALRTLPPYAGPGLDSGLRPRGAPLGPPPPRQPGALAYGAFGPPSSFQPFPAVPPPAAGIAHLQPVATPYPGRAAAPPNAPGGPPGPQPAPSAAAPPPPAHALGGMDAELIDEEALTSLELELGLHRVRELPELFLGQSEFDCFSDLGSAPPAGSVSCGGSGGGSGPKKKRKVGIHGVPAALEPGEKPYKCPECGKSFSRRDELNVHQRTHTGEKPYKCPECGKSFSSRRTCRAHQRTHTGEKPYKCPECGKSFSQSSNLVRHQRTHTGEKPYKCPECGKSFSQLAHLRAHQRTHTGEKPYKCPECGKSFSTSGNLVRHQRTHTGEKPYKCPECGKSFSHRTTLTNHQRTHTGKKTSKRPAATKKAGQAKKKKGSYPYDVPDYALEMADHLMLAEGYRLVQRPPSAAAAHGPHALRTLPPYAGPGLDSGLRPRGAPLGPPPPRQPGALAYGAFGPPSSFQPFPAVPPPAAGIAHLQPVATPYPGRAAAPPNAPGGPPGPQPAPSAAAPPPPAHALGGMDAELIDEEALTSLELELGLHRVRELPELFLGQSEFDCFSDLGSAPPAGSVSC

SEQ ID NO: 55 - protein, 479 aa, Artificial Sequence
  Description of Artificial Sequence: Synthetic polypeptide
MQSQLIKPSRMRKYPNRPSKTPPHERPYACPVESCDRRFSRRDELNVHIRIHTGQKPFQCRICMRNFSSRRTCRAHIRTHTGEKPFACDICGRKFAQSSNLVRHTKIHLRQKDRPYACPVESCDRRFSQLAHLRAHIRIHTGQKPFQCRICMRNFSTSGNLVRHIRTHTGEKPFACDICGRKFAHRTTLTNHTKIHLRQKDKLEMSGLEMADHMMAMNHGRFPDGTNGLHHHPAHRMGMGQFPSPHHHQQQQPQHAFNALMGEHIHYGAGNMNATSGIRHAMGPGTVNGGHPPSALAPAARFNNSQFMGPPVASQGGSLPASMQLQKLNNQYFNHHPYPHNHYMPDLHPAAGHQMNGTNQHFRDCNPKHSGGSSTPGGSGGSSTPGGSGSSSGGGAGSSNSGGGSGSGNMPASVAHVPAAMLPPNVIDTDFIDEEVLMSLVIEMGLDRIKELPELWLGQNEFDFMTDFVCKQQPSRVSC

SEQ ID NO: 56 - protein, 476 aa, Artificial Sequence
  Description of Artificial Sequence: Synthetic polypeptide
MSGLEMADHMMAMNHGRFPDGTNGLHHHPAHRMGMGQFPSPHHHQQQQPQHAFNALMGEHIHYGAGNMNATSGVRHAMGPGTVNGGHPPSALAPAARFNNSQFMGPPVASQGGSLPASMQLQKLNNQYFNHHPYPHNHYMPDLHPAAGHQMNGTNQHFRDCNPKHSGGSSTPGGSGGSSTPGGSGSSSGGGAGSSNSGGGSGSGNMPASVAHVPAAMLPPNVIDTDFIDEEVLMSLVIEMGLDRIKELPELWLGQNEFDFMTDFVCKQQPSRVSCQSQLIKPSRMRKYPNRPSKTPPHERPYACPVESCDRRFSRRDELNVHIRIHTGQKPFQCRICMRNFSSRRTCRAHIRTHTGEKPFACDICGRKFAQSSNLVRHTKIHLRQKDRPYACPVESCDRRFSQLAHLRAHIRIHTGQKPFQCRICMRNFSTSGNLVRHIRTHTGEKPFACDICGRKFAHRTTLTNHTKIHLRQKDK

SEQ ID NO: 57 - protein, 479 aa, Artificial Sequence
  Description of Artificial Sequence: Synthetic polypeptide
MQSQLIKPSRMRKYPNRPSKTPPHERPYACPVESCDRRFSRSDNLVRHIRIHTGQKPFQCRICMRNFSREDNLHTHIRTHTGEKPFACDICGRKFARSDELVRHTKIHLRQKDRPYACPVESCDRRFSQSGNLTEHIRIHTGQKPFQCRICMRNFSTSGHLVRHIRTHTGEKPFACDICGRKFAQNSTLTEHTKIHLRQKDKLEMSGLEMADHMMAMNHGRFPDGTNGLHHHPAHRMGMGQFPSPHHHQQQQPQHAFNALMGEHIHYGAGNMNATSGIRHAMGPGTVNGGHPPSALAPAARFNNSQFMGPPVASQGGSLPASMQLQKLNNQYFNHHPYPHNHYMPDLHPAAGHQMNGTNQHFRDCNPKHSGGSSTPGGSGGSSTPGGSGSSSGGGAGSSNSGGGSGSGNMPASVAHVPAAMLPPNVIDTDFIDEEVLMSLVIEMGLDRIKELPELWLGQNEFDFMTDFVCKQQPSRVSC

SEQ ID NO: 58 - protein, 476 aa, Artificial Sequence
  Description of Artificial Sequence: Synthetic polypeptide
MSGLEMADHMMAMNHGRFPDGTNGLHHHPAHRMGMGQFPSPHHHQQQQPQHAFNALMGEHIHYGAGNMNATSGVRHAMGPGTVNGGHPPSALAPAARFNNSQFMGPPVASQGGSLPASMQLQKLNNQYFNHHPYPHNHYMPDLHPAAGHQMNGTNQHFRDCNPKHSGGSSTPGGSGGSSTPGGSGSSSGGGAGSSNSGGGSGSGNMPASVAHVPAAMLPPNVIDTDFIDEEVLMSLVIEMGLDRIKELPELWLGQNEFDFMTDFVCKQQPSRVSCQSQLIKPSRMRKYPNRPSKTPPHERPYACPVESCDRRFSRSDNLVRHIRIHTGQKPFQCRICMRNFSREDNLHTHIRTHTGEKPFACDICGRKFARSDELVRHTKIHLRQKDRPYACPVESCDRRFSQSGNLTEHIRIHTGQKPFQCRICMRNFSTSGHLVRHIRTHTGEKPFACDICGRKFAQNSTLTEHTKIHLRQKDK

SEQ ID NO: 59 - protein, 479 aa, Artificial Sequence
  Description of Artificial Sequence: Synthetic polypeptide
  MOD_RES (278)..(278): Ile or Val
MQSQLIKPSRMRKYPNRPSKTPPHERPYACPVESCDRRFSSPADLTRHIRIHTGQKPFQCRICMRNFSDSGNLRVHIRTHTGEKPFACDICGRKFAQLAHLRAHTKIHLRQKDRPYACPVESCDRRFSQRANLRAHIRIHTGQKPFQCRICMRNFSREDNLHTHIRTHTGEKPFACDICGRKFARSDNLVRHTKIHLRQKDKLEMSGLEMADHMMAMNHGRFPDGTNGLHHHPAHRMGMGQFPSPHHHQQQQPQHAFNALMGEHIHYGAGNMNATSGXRHAMGPGTVNGGHPPSALAPAARFNNSQFMGPPVASQGGSLPASMQLQKLNNQYFNHHPYPHNHYMPDLHPAAGHQMNGTNQHFRDCNPKHSGGSSTPGGSGGSSTPGGSGSSSGGGAGSSNSGGGSGSGNMPASVAHVPAAMLPPNVIDTDFIDEEVLMSLVIEMGLDRIKELPELWLGQNEFDFMTDFVCKQQPSRVSC

SEQ ID NO: 60 - protein, 476 aa, Artificial Sequence; identical to SEQ ID NO: 56
  Description of Artificial Sequence: Synthetic polypeptide

SEQ ID NO: 61 - protein, 388 aa, Artificial Sequence
  Description of Artificial Sequence: Synthetic polypeptide
MQSQLIKPSRMRKYPNRPSKTPPHERPYACPVESCDRRFSRSDNLVRHIRIHTGQKPFQCRICMRNFSREDNLHTHIRTHTGEKPFACDICGRKFARSDELVRHTKIHLRQKDRPYACPVESCDRRFSQSGNLTEHIRIHTGQKPFQCRICMRNFSTSGHLVRHIRTHTGEKPFACDICGRKFAQNSTLTEHTKIHLRQKDKLEMADHLMLAEGYRLVQRPPSAAAAHGPHALRTLPPYAGPGLDSGLRPRGAPLGPPPPRQPGALAYGAFGPPSSFQPFPAVPPPAAGIAHLQPVATPYPGRAAAPPNAPGGPPGPQPAPSAAAPPPPAHALGGMDAELIDEEALTSLELELGLHRVRELPELFLGQSEFDCFSDLGSAPPAGSVSC

SEQ ID NO: 62 - protein, 580 aa, Artificial Sequence
  Description of Artificial Sequence: Synthetic polypeptide
MAADHLMLAEGYRLVQRPPSAAAAHGPHALRTLPPYAGPGLDSGLRPRGAPLGPPPPRQPGALAYGAFGPPSSFQPFPAVPPPAAGIAHLQPVATPYPGRAAAPPNAPGGPPGPQPAPSAAAPPPPAHALGGMDAELIDEEALTSLELELGLHRVRELPELFLGQSEFDCFSDLGSAPPAGSVSCGGSGGGSGQSQLIKPSRMRKYPNRPSKTPPHERPYACPVESCDRRFSRSDNLVRHIRIHTGQKPFQCRICMRNFSREDNLHTHIRTHTGEKPFACDICGRKFARSDELVRHTKIHLRQKDRPYACPVESCDRRFSQSGNLTEHIRIHTGQKPFQCRICMRNFSTSGHLVRHIRTHTGEKPFACDICGRKFAQNSTLTEHTKIHLRQKDKLEMADHLMLAEGYRLVQRPPSAAAAHGPHALRTLPPYAGPGLDSGLRPRGAPLGPPPPRQPGALAYGAFGPPSSFQPFPAVPPPAAGIAHLQPVATPYPGRAAAPPNAPGGPPGPQPAPSAAAPPPPAHALGGMDAELIDEEALTSLELELGLHRVRELPELFLGQSEFDCFSDLGSAPPAGSVSC

SEQ ID NO: 63 - protein, 388 aa, Artificial Sequence
  Description of Artificial Sequence: Synthetic polypeptide
MQSQLIKPSRMRKYPNRPSKTPPHERPYACPVESCDRRFSSPADLTRHIRIHTGQKPFQCRICMRNFSDSGNLRVHIRTHTGEKPFACDICGRKFAQLAHLRAHTKIHLRQKDRPYACPVESCDRRFSQRANLRAHIRIHTGQKPFQCRICMRNFSREDNLHTHIRTHTGEKPFACDICGRKFARSDNLVRHTKIHLRQKDKLEMADHLMLAEGYRLVQRPPSAAAAHGPHALRTLPPYAGPGLDSGLRPRGAPLGPPPPRQPGALAYGAFGPPSSFQPFPAVPPPAAGIAHLQPVATPYPGRAAAPPNAPGGPPGPQPAPSAAAPPPPAHALGGMDAELIDEEALTSLELELGLHRVRELPELFLGQSEFDCFSDLGSAPPAGSVSC

SEQ ID NO: 64 - protein, 580 aa, Artificial Sequence
  Description of Artificial Sequence: Synthetic polypeptide
MAADHLMLAEGYRLVQRPPSAAAAHGPHALRTLPPYAGPGLDSGLRPRGAPLGPPPPRQPGALAYGAFGPPSSFQPFPAVPPPAAGIAHLQPVATPYPGRAAAPPNAPGGPPGPQPAPSAAAPPPPAHALGGMDAELIDEEALTSLELELGLHRVRELPELFLGQSEFDCFSDLGSAPPAGSVSCGGSGGGSGQSQLIKPSRMRKYPNRPSKTPPHERPYACPVESCDRRFSSPADLTRHIRIHTGQKPFQCRICMRNFSDSGNLRVHIRTHTGEKPFACDICGRKFAQLAHLRAHTKIHLRQKDRPYACPVESCDRRFSQRANLRAHIRIHTGQKPFQCRICMRNFSREDNLHTHIRTHTGEKPFACDICGRKFARSDNLVRHTKIHLRQKDKLEMADHLMLAEGYRLVQRPPSAAAAHGPHALRTLPPYAGPGLDSGLRPRGAPLGPPPPRQPGALAYGAFGPPSSFQPFPAVPPPAAGIAHLQPVATPYPGRAAAPPNAPGGPPGPQPAPSAAAPPPPAHALGGMDAELIDEEALTSLELELGLHRVRELPELFLGQSEFDCFSDLGSAPPAGSVSC

SEQ ID NO: 65 - protein, 388 aa, Artificial Sequence
  Description of Artificial Sequence: Synthetic polypeptide
MQSQLIKPSRMRKYPNRPSKTPPHERPYACPVESCDRRFSRRDELNVHIRIHTGQKPFQCRICMRNFSSRRTCRAHIRTHTGEKPFACDICGRKFAQSSNLVRHTKIHLRQKDRPYACPVESCDRRFSQLAHLRAHIRIHTGQKPFQCRICMRNFSTSGNLVRHIRTHTGEKPFACDICGRKFAHRTTLTNHTKIHLRQKDKLEMADHLMLAEGYRLVQRPPSAAAAHGPHALRTLPPYAGPGLDSGLRPRGAPLGPPPPRQPGALAYGAFGPPSSFQPFPAVPPPAAGIAHLQPVATPYPGRAAAPPNAPGGPPGPQPAPSAAAPPPPAHALGGMDAELIDEEALTSLELELGLHRVRELPELFLGQSEFDCFSDLGSAPPAGSVSC

SEQ ID NO: 66 - protein, 580 aa, Artificial Sequence
  Description of Artificial Sequence: Synthetic polypeptide
MAADHLMLAEGYRLVQRPPSAAAAHGPHALRTLPPYAGPGLDSGLRPRGAPLGPPPPRQPGALAYGAFGPPSSFQPFPAVPPPAAGIAHLQPVATPYPGRAAAPPNAPGGPPGPQPAPSAAAPPPPAHALGGMDAELIDEEALTSLELELGLHRVRELPELFLGQSEFDCFSDLGSAPPAGSVSCGGSGGGSGQSQLIKPSRMRKYPNRPSKTPPHERPYACPVESCDRRFSRRDELNVHIRIHTGQKPFQCRICMRNFSSRRTCRAHIRTHTGEKPFACDICGRKFAQSSNLVRHTKIHLRQKDRPYACPVESCDRRFSQLAHLRAHIRIHTGQKPFQCRICMRNFSTSGNLVRHIRTHTGEKPFACDICGRKFAHRTTLTNHTKIHLRQKDKLEMADHLMLAEGYRLVQRPPSAAAAHGPHALRTLPPYAGPGLDSGLRPRGAPLGPPPPRQPGALAYGAFGPPSSFQPFPAVPPPAAGIAHLQPVATPYPGRAAAPPNAPGGPPGPQPAPSAAAPPPPAHALGGMDAELIDEEALTSLELELGLHRVRELPELFLGQSEFDCFSDLGSAPPAGSVSC

SEQ ID NO: 67 - protein, 580 aa, Artificial Sequence
  Description of Artificial Sequence: Synthetic polypeptide
MAADHLMLAEGYRLVQRPPSAAAAHGPHALRTLPPYAGPGLDSGLRPRGAPLGPPPPRQPGALAYGAFGPPSSFQPFPAVPPPAAGIAHLQPVATPYPGRAAAPPNAPGGPPGPQPAPSAAAPPPPAHALGGMDAELIDEEALTSLELELGLHRVRELPELFLGQSEFDCFSDLGSAPPAGSVSCGGSGGGSGQSQLIKPSRMRKYPNRPSKTPPHERPYACPVESCDRRFSRSDNLVRHIRIHTGQKPFQCRICMRNFSHRTTLTNHIRTHTGEKPFACDICGRKFAREDNLHTHTKIHLRQKDRPYACPVESCDRRFSTSHSLTEHIRIHTGQKPFQCRICMRNFSQSSSLVRHIRTHTGEKPFACDICGRKFAREDNLHTHTKIHLRQKDKLEMADHLMLAEGYRLVQRPPSAAAAHGPHALRTLPPYAGPGLDSGLRPRGAPLGPPPPRQPGALAYGAFGPPSSFQPFPAVPPPAAGIAHLQPVATPYPGRAAAPPNAPGGPPGPQPAPSAAAPPPPAHALGGMDAELIDEEALTSLELELGLHRVRELPELFLGQSEFDCFSDLGSAPPAGSVSC

SEQ ID NO: 68 - protein, 394 aa, Artificial Sequence
  Description of Artificial Sequence: Synthetic polypeptide
MAADHLMLAEGYRLVQRPPSAAAAHGPHALRTLPPYAGPGLDSGLRPRGAPLGPPPPRQPGALAYGAFGPPSSFQPFPAVPPPAAGIAHLQPVATPYPGRAAAPPNAPGGPPGPQPAPSAAAPPPPAHALGGMDAELIDEEALTSLELELGLHRVRELPELFLGQSEFDCFSDLGSAPPAGSVSCGGSGGGSGQSQLIKPSRMRKYPNRPSKTPPHERPYACPVESCDRRFSRSDNLVRHIRIHTGQKPFQCRICMRNFSHRTTLTNHIRTHTGEKPFACDICGRKFAREDNLHTHTKIHLRQKDRPYACPVESCDRRFSTSHSLTEHIRIHTGQKPFQCRICMRNFSQSSSLVRHIRTHTGEKPFACDICGRKFAREDNLHTHTKIHLRQKDK

SEQ ID NO: 69 - protein, 394 aa, Artificial Sequence
  Description of Artificial Sequence: Synthetic polypeptide
MAADHLMLAEGYRLVQRPPSAAAAHGPHALRTLPPYAGPGLDSGLRPRGAPLGPPPPRQPGALAYGAFGPPSSFQPFPAVPPPAAGIAHLQPVATPYPGRAAAPPNAPGGPPGPQPAPSAAAPPPPAHALGGMDAELIDEEALTSLELELGLHRVRELPELFLGQSEFDCFSDLGSAPPAGSVSCGGSGGGSGQSQLIKPSRMRKYPNRPSKTPPHERPYACPVESCDRRFSRSDNLVRHIRIHTGQKPFQCRICMRNFSREDNLHTHIRTHTGEKPFACDICGRKFARSDELVRHTKIHLRQKDRPYACPVESCDRRFSQSGNLTEHIRIHTGQKPFQCRICMRNFSTSGHLVRHIRTHTGEKPFACDICGRKFAQNSTLTEHTKIHLRQKDK

SEQ ID NO: 70 - protein, 479 aa, Artificial Sequence
  Description of Artificial Sequence: Synthetic polypeptide
MRPHACPAEGCDRRFSRSDNLVRHLRIHTGHKPFQCRICMRSFSREDNLHTHIRTHTGEKPFACEFCGRKFARSDELVRHAKIHLKQKEHACPAEGCDRRFSQSGNLTEHLRIHTGHKPFQCRICMRSFSTSGHLVRHIRTHTGEKPFACEFCGRKFAQNSTLTEHAKIHLKQKEKKAEKGGAPSASSAPPVSLAPVVTTCALEMSGLEMADHMMAMNHGRFPDGTNGLHHHPAHRMGMGQFPSPHHHQQQQPQHAFNALMGEHIHYGAGNMNATSGIRHAMGPGTVNGGHPPSALAPAARFNNSQFMGPPVASQGGSLPASMQLQKLNNQYFNHHPYPHNHYMPDLHPAAGHQMNGTNQHFRDCNPKHSGGSSTPGGSGGSSTPGGSGSSSGGGAGSSNSGGGSGSGNMPASVAHVPAAMLPPNVIDTDFIDEEVLMSLVIEMGLDRIKELPELWLGQNEFDFMTDFVCKQQPSRVSC

SEQ ID NO: 71 - protein, 476 aa, Artificial Sequence
  Description of Artificial Sequence: Synthetic polypeptide
MSGLEMADHMMAMNHGRFPDGTNGLHHHPAHRMGMGQFPSPHHHQQQQPQHAFNALMGEHIHYGAGNMNATSGVRHAMGPGTVNGGHPPSALAPAARFNNSQFMGPPVASQGGSLPASMQLQKLNNQYFNHHPYPHNHYMPDLHPAAGHQMNGTNQHFRDCNPKHSGGSSTPGGSGGSSTPGGSGSSSGGGAGSSNSGGGSGSGNMPASVAHVPAAMLPPNVIDTDFIDEEVLMSLVIEMGLDRIKELPELWLGQNEFDFMTDFVCKQQPSRVSCRPHACPAEGCDRRFSRSDNLVRHLRIHTGHKPFQCRICMRSFSREDNLHTHIRTHTGEKPFACEFCGRKFARSDELVRHAKIHLKQKEHACPAEGCDRRFSQSGNLTEHLRIHTGHKPFQCRICMRSFSTSGHLVRHIRTHTGEKPFACEFCGRKFAQNSTLTEHAKIHLKQKEKKAEKGGAPSASSAPPVSLAPVVTTCA

SEQ ID NO: 72 - protein, 479 aa, Artificial Sequence
  Description of Artificial Sequence: Synthetic polypeptide
  MOD_RES (278)..(278): Ile or Val
MRPHACPAEGCDRRFSSPADLTRHLRIHTGHKPFQCRICMRSFSDSGNLRVHIRTHTGEKPFACEFCGRKFAQLAHLRAHAKIHLKQKEHACPAEGCDRRFSQRANLRAHLRIHTGHKPFQCRICMRSFSREDNLHTHIRTHTGEKPFACEFCGRKFARSDNLVRHAKIHLKQKEKKAEKGGAPSASSAPPVSLAPVVTTCALEMSGLEMADHMMAMNHGRFPDGTNGLHHHPAHRMGMGQFPSPHHHQQQQPQHAFNALMGEHIHYGAGNMNATSGXRHAMGPGTVNGGHPPSALAPAARFNNSQFMGPPVASQGGSLPASMQLQKLNNQYFNHHPYPHNHYMPDLHPAAGHQMNGTNQHFRDCNPKHSGGSSTPGGSGGSSTPGGSGSSSGGGAGSSNSGGGSGSGNMPASVAHVPAAMLPPNVIDTDFIDEEVLMSLVIEMGLDRIKELPELWLGQNEFDFMTDFVCKQQPSRVSC

SEQ ID NO: 73 - protein, 476 aa, Artificial Sequence
  Description of Artificial Sequence: Synthetic polypeptide
MSGLEMADHMMAMNHGRFPDGTNGLHHHPAHRMGMGQFPSPHHHQQQQPQHAFNALMGEHIHYGAGNMNATSGVRHAMGPGTVNGGHPPSALAPAARFNNSQFMGPPVASQGGSLPASMQLQKLNNQYFNHHPYPHNHYMPDLHPAAGHQMNGTNQHFRDCNPKHSGGSSTPGGSGGSSTPGGSGSSSGGGAGSSNSGGGSGSGNMPASVAHVPAAMLPPNVIDTDFIDEEVLMSLVIEMGLDRIKELPELWLGQNEFDFMTDFVCKQQPSRVSCRPHACPAEGCDRRFSSPADLTRHLRIHTGHKPFQCRICMRSFSDSGNLRVHIRTHTGEKPFACEFCGRKFAQLAHLRAHAKIHLKQKEHACPAEGCDRRFSQRANLRAHLRIHTGHKPFQCRICMRSFSREDNLHTHIRTHTGEKPFACEFCGRKFARSDNLVRHAKIHLKQKEKKAEKGGAPSASSAPPVSLAPVVTTCA

SEQ ID NO: 74 - protein, 362 aa, Artificial Sequence
  Description of Artificial Sequence: Synthetic polypeptide
MRPHACPAEGCDRRFSRSDNLVRHLRIHTGHKPFQCRICMRSFSREDNLHTHIRTHTGEKPFACEFCGRKFARSDELVRHAKIHLKQKEHACPAEGCDRRFSQSGNLTEHLRIHTGHKPFQCRICMRSFSTSGHLVRHIRTHTGEKPFACEFCGRKFAQNSTLTEHAKIHLKQKEKLEMADHLMLAEGYRLVQRPPSAAAAHGPHALRTLPPYAGPGLDSGLRPRGAPLGPPPPRQPGALAYGAFGPPSSFQPFPAVPPPAAGIAHLQPVATPYPGRAAAPPNAPGGPPGPQPAPSAAAPPPPAHALGGMDAELIDEEALTSLELELGLHRVRELPELFLGQSEFDCFSDLGSAPPAGSVSC

SEQ ID NO: 75 - protein, 554 aa, Artificial Sequence
  Description of Artificial Sequence: Synthetic polypeptide
MAADHLMLAEGYRLVQRPPSAAAAHGPHALRTLPPYAGPGLDSGLRPRGAPLGPPPPRQPGALAYGAFGPPSSFQPFPAVPPPAAGIAHLQPVATPYPGRAAAPPNAPGGPPGPQPAPSAAAPPPPAHALGGMDAELIDEEALTSLELELGLHRVRELPELFLGQSEFDCFSDLGSAPPAGSVSCGGSGGGSGRPHACPAEGCDRRFSRSDNLVRHLRIHTGHKPFQCRICMRSFSREDNLHTHIRTHTGEKPFACEFCGRKFARSDELVRHAKIHLKQKEHACPAEGCDRRFSQSGNLTEHLRIHTGHKPFQCRICMRSFSTSGHLVRHIRTHTGEKPFACEFCGRKFAQNSTLTEHAKIHLKQKEKLEMADHLMLAEGYRLVQRPPSAAAAHGPHALRTLPPYAGPGLDSGLRPRGAPLGPPPPRQPGALAYGAFGPPSSFQPFPAVPPPAAGIAHLQPVATPYPGRAAAPPNAPGGPPGPQPAPSAAAPPPPAHALGGMDAELIDEEALTSLELELGLHRVRELPELFLGQSEFDCFSDLGSAPPAGSVSC

SEQ ID NO: 76 - protein, 362 aa, Artificial Sequence
  Description of Artificial Sequence: Synthetic polypeptide
MRPHACPAEGCDRRFSSPADLTRHLRIHTGHKPFQCRICMRSFSDSGNLRVHIRTHTGEKPFACEFCGRKFAQLAHLRAHAKIHLKQKEHACPAEGCDRRFSQRANLRAHLRIHTGHKPFQCRICMRSFSREDNLHTHIRTHTGEKPFACEFCGRKFARSDNLVRHAKIHLKQKEKLEMADHLMLAEGYRLVQRPPSAAAAHGPHALRTLPPYAGPGLDSGLRPRGAPLGPPPPRQPGALAYGAFGPPSSFQPFPAVPPPAAGIAHLQPVATPYPGRAAAPPNAPGGPPGPQPAPSAAAPPPPAHALGGMDAELIDEEALTSLELELGLHRVRELPELFLGQSEFDCFSDLGSAPPAGSVSC

SEQ ID NO: 77 - protein, 554 aa, Artificial Sequence
  Description of Artificial Sequence: Synthetic polypeptide
MAADHLMLAEGYRLVQRPPSAAAAHGPHALRTLPPYAGPGLDSGLRPRGAPLGPPPPRQPGALAYGAFGPPSSFQPFPAVPPPAAGIAHLQPVATPYPGRAAAPPNAPGGPPGPQPAPSAAAPPPPAHALGGMDAELIDEEALTSLELELGLHRVRELPELFLGQSEFDCFSDLGSAPPAGSVSCGGSGGGSGRPHACPAEGCDRRFSSPADLTRHLRIHTGHKPFQCRICMRSFSDSGNLRVHIRTHTGEKPFACEFCGRKFAQLAHLRAHAKIHLKQKEHACPAEGCDRRFSQRANLRAHLRIHTGHKPFQCRICMRSFSREDNLHTHIRTHTGEKPFACEFCGRKFARSDNLVRHAKIHLKQKEKLEMADHLMLAEGYRLVQRPPSAAAAHGPHALRTLPPYAGPGLDSGLRPRGAPLGPPPPRQPGALAYGAFGPPSSFQPFPAVPPPAAGIAHLQPVATPYPGRAAAPPNAPGGPPGPQPAPSAAAPPPPAHALGGMDAELIDEEALTSLELELGLHRVRELPELFLGQSEFDCFSDLGSAPPAGSVSC

SEQ ID NO: 78 - protein, 453 aa, Artificial Sequence
  Description of Artificial Sequence: Synthetic polypeptide
MRPHACPAEGCDRRFSRRDELNVHLRIHTGHKPFQCRICMRSFSSRRTCRAHIRTHTGEKPFACEFCGRKFAQSSNLVRHAKIHLKQKEHACPAEGCDRRFSQLAHLRAHLRIHTGHKPFQCRICMRSFSTSGNLVRHIRTHTGEKPFACEFCGRKFAHRTTLTNHAKIHLKQKEKLEMSGLEMADHMMAMNHGRFPDGTNGLHHHPAHRMGMGQFPSPHHHQQQQPQHAFNALMGEHIHYGAGNMNATSGIRHAMGPGTVNGGHPPSALAPAARFNNSQFMGPPVASQGGSLPASMQLQKLNNQYFNHHPYPHNHYMPDLHPAAGHQMNGTNQHFRDCNPKHSGGSSTPGGSGGSSTPGGSGSSSGGGAGSSNSGGGSGSGNMPASVAHVPAAMLPPNVIDTDFIDEEVLMSLVIEMGLDRIKELPELWLGQNEFDFMTDFVCKQQPSRVSC

SEQ ID NO: 79 - protein, 554 aa, Artificial Sequence
  Description of Artificial Sequence: Synthetic polypeptide
MAADHLMLAEGYRLVQRPPSAAAAHGPHALRTLPPYAGPGLDSGLRPRGAPLGPPPPRQPGALAYGAFGPPSSFQPFPAVPPPAAGIAHLQPVATPYPGRAAAPPNAPGGPPGPQPAPSAAAPPPPAHALGGMDAELIDEEALTSLELELGLHRVRELPELFLGQSEFDCFSDLGSAPPAGSVSCGGSGGGSGRPHACPAEGCDRRFSRRDELNVHLRIHTGHKPFQCRICMRSFSSRRTCRAHIRTHTGEKPFACEFCGRKFAQSSNLVRHAKIHLKQKEHACPAEGCDRRFSQLAHLRAHLRIHTGHKPFQCRICMRSFSTSGNLVRHIRTHTGEKPFACEFCGRKFAHRTTLTNHAKIHLKQKEKLEMADHLMLAEGYRLVQRPPSAAAAHGPHALRTLPPYAGPGLDSGLRPRGAPLGPPPPRQPGALAYGAFGPPSSFQPFPAVPPPAAGIAHLQPVATPYPGRAAAPPNAPGGPPGPQPAPSAAAPPPPAHALGGMDAELIDEEALTSLELELGLHRVRELPELFLGQSEFDCFSDLGSAPPAGSVSC

SEQ ID NO: 80 - protein, 362 aa, Artificial Sequence
  Description of Artificial Sequence: Synthetic polypeptide
MRPHACPAEGCDRRFSRRDELNVHLRIHTGHKPFQCRICMRSFSSRRTCRAHIRTHTGEKPFACEFCGRKFAQSSNLVRHAKIHLKQKEHACPAEGCDRRFSQLAHLRAHLRIHTGHKPFQCRICMRSFSTSGNLVRHIRTHTGEKPFACEFCGRKFAHRTTLTNHAKIHLKQKEKLEMADHLMLAEGYRLVQRPPSAAAAHGPHALRTLPPYAGPGLDSGLRPRGAPLGPPPPRQPGALAYGAFGPPSSFQPFPAVPPPAAGIAHLQPVATPYPGRAAAPPNAPGGPPGPQPAPSAAAPPPPAHALGGMDAELIDEEALTSLELELGLHRVRELPELFLGQSEFDCFSDLGSAPPAGSVSC

SEQ ID NO: 81 - protein, 176 aa, Artificial Sequence; identical to SEQ ID NO: 18
  Description of Artificial Sequence: Synthetic polypeptide

SEQ ID NO: 82 - protein, 202 aa, Artificial Sequence
  Description of Artificial Sequence: Synthetic polypeptide
MQSQLIKPSRMRKYPNRPSKTPPHERPYACPVESCDRRFSRRDELNVHIRIHTGQKPFQCRICMRNFSSRRTCRAHIRTHTGEKPFACDICGRKFAQSSNLVRHTKIHLRQKDRPYACPVESCDRRFSQLAHLRAHIRIHTGQKPFQCRICMRNFSTSGNLVRHIRTHTGEKPFACDICGRKFAHRTTLTNHTKIHLRQKDK

SEQ ID NO: 83 - protein, 201 aa, Artificial Sequence
  Description of Artificial Sequence: Synthetic polypeptide
QSQLIKPSRMRKYPNRPSKTPPHERPYACPVESCDRRFSRRDELNVHIRIHTGQKPFQCRICMRNFSSRRTCRAHIRTHTGEKPFACDICGRKFAQSSNLVRHTKIHLRQKDRPYACPVESCDRRFSQLAHLRAHIRIHTGQKPFQCRICMRNFSTSGNLVRHIRTHTGEKPFACDICGRKFAHRTTLTNHTKIHLRQKDK

SEQ ID NO: 84 - protein, 176 aa, Artificial Sequence; identical to SEQ ID NO: 22
  Description of Artificial Sequence: Synthetic polypeptide

SEQ ID NO: 85 - protein, 201 aa, Artificial Sequence
  Description of Artificial Sequence: Synthetic polypeptide
QSQLIKPSRMRKYPNRPSKTPPHERPYACPVESCDRRFSRSDNLVRHIRIHTGQKPFQCRICMRNFSREDNLHTHIRTHTGEKPFACDICGRKFARSDELVRHTKIHLRQKDRPYACPVESCDRRFSQSGNLTEHIRIHTGQKPFQCRICMRNFSTSGHLVRHIRTHTGEKPFACDICGRKFAQNSTLTEHTKIHLRQKDK

SEQ ID NO: 86 - protein, 202 aa, Artificial Sequence
  Description of Artificial Sequence: Synthetic polypeptide
MQSQLIKPSRMRKYPNRPSKTPPHERPYACPVESCDRRFSSPADLTRHIRIHTGQKPFQCRICMRNFSDSGNLRVHIRTHTGEKPFACDICGRKFAQLAHLRAHTKIHLRQKDRPYACPVESCDRRFSQRANLRAHIRIHTGQKPFQCRICMRNFSREDNLHTHIRTHTGEKPFACDICGRKFARSDNLVRHTKIHLRQKDK

SEQ ID NO: 87 - protein, 177 aa, Artificial Sequence
  Description of Artificial Sequence: Synthetic polypeptide
RPYACPVESCDRRFSRRDELNVHIRIHTGQKPFQCRICMRNFSSRRTCRAHIRTHTGEKPFACDICGRKFAQSSNLVRHTKIHLRQKDRPYACPVESCDRRFSQLAHLRAHIRIHTGQKPFQCRICMRNFSTSGNLVRHIRTHTGEKPFACDICGRKFAHRTTLTNHTKIHLRQKDK

SEQ ID NO: 88 - protein, 177 aa, Artificial Sequence
  Description of Artificial Sequence: Synthetic polypeptide
RPYACPVESCDRRFSRSDNLVRHIRIHTGQKPFQCRICMRNFSREDNLHTHIRTHTGEKPFACDICGRKFARSDELVRHTKIHLRQKDRPYACPVESCDRRFSQSGNLTEHIRIHTGQKPFQCRICMRNFSTSGHLVRHIRTHTGEKPFACDICGRKFAQNSTLTEHTKIHLRQKDK

SEQ ID NO: 89 - protein, 177 aa, Artificial Sequence
  Description of Artificial Sequence: Synthetic polypeptide
RPYACPVESCDRRFSSPADLTRHIRIHTGQKPFQCRICMRNFSDSGNLRVHIRTHTGEKPFACDICGRKFAQLAHLRAHTKIHLRQKDRPYACPVESCDRRFSQRANLRAHIRIHTGQKPFQCRICMRNFSREDNLHTHIRTHTGEKPFACDICGRKFARSDNLVRHTKIHLRQKDK

SEQ ID NO: 90 - protein, 201 aa, Artificial Sequence
  Description of Artificial Sequence: Synthetic polypeptide
QSQLIKPSRMRKYPNRPSKTPPHERPYACPVESCDRRFSRSDNLVRHIRIHTGQKPFQCRICMRNFSHRTTLTNHIRTHTGEKPFACDICGRKFAREDNLHTHTKIHLRQKDRPYACPVESCDRRFSTSHSLTEHIRIHTGQKPFQCRICMRNFSQSSSLVRHIRTHTGEKPFACDICGRKFAREDNLHTHTKIHLRQKDK

SEQ ID NO: 91 - protein, 201 aa, Artificial Sequence; identical to SEQ ID NO: 85
  Description of Artificial Sequence: Synthetic polypeptide

SEQ ID NO: 92 - protein, 172 aa, Artificial Sequence
  Description of Artificial Sequence: Synthetic polypeptide
HACPAEGCDRRFSRSDNLVRHLRIHTGHKPFQCRICMRSFSREDNLHTHIRTHTGEKPFACEFCGRKFARSDELVRHAKIHLKQKEHACPAEGCDRRFSQSGNLTEHLRIHTGHKPFQCRICMRSFSTSGHLVRHIRTHTGEKPFACEFCGRKFAQNSTLTEHAKIHLKQKE

SEQ ID NO: 93 - protein, 172 aa, Artificial Sequence
  Description of Artificial Sequence: Synthetic polypeptide
HACPAEGCDRRFSSPADLTRHLRIHTGHKPFQCRICMRSFSDSGNLRVHIRTHTGEKPFACEFCGRKFAQLAHLRAHAKIHLKQKEHACPAEGCDRRFSQRANLRAHLRIHTGHKPFQCRICMRSFSREDNLHTHIRTHTGEKPFACEFCGRKFARSDNLVRHAKIHLKQKE

SEQ ID NO: 94 - protein, 172 aa, Artificial Sequence; identical to SEQ ID NO: 28
  Description of Artificial Sequence: Synthetic polypeptide

SEQ ID NO: 95 - protein, 50 aa, Artificial Sequence
  Description of Artificial Sequence: Synthetic polypeptide
DALDDFDLDMLGSDALDDFDLDMLGSDALDDFDLDMLGSDALDDFDLDML

SEQ ID NO: 96 - protein, 275 aa, Artificial Sequence
  Description of Artificial Sequence: Synthetic polypeptide
MSGLEMADHMMAMNHGRFPDGTNGLHHHPAHRMGMGQFPSPHHHQQQQPQHAFNALMGEHIHYGAGNMNATSGVRHAMGPGTVNGGHPPSALAPAARFNNSQFMGPPVASQGGSLPASMQLQKLNNQYFNHHPYPHNHYMPDLHPAAGHQMNGTNQHFRDCNPKHSGGSSTPGGSGGSSTPGGSGSSSGGGAGSSNSGGGSGSGNMPASVAHVPAAMLPPNVIDTDFIDEEVLMSLVIEMGLDRIKELPELWLGQNEFDFMTDFVCKQQPSRVSC

SEQ ID NO: 97 - protein, 184 aa, Artificial Sequence
  Description of Artificial Sequence: Synthetic polypeptide
MADHLMLAEGYRLVQRPPSAAAAHGPHALRTLPPYAGPGLDSGLRPRGAPLGPPPPRQPGALAYGAFGPPSSFQPFPAVPPPAAGIAHLQPVATPYPGRAAAPPNAPGGPPGPQPAPSAAAPPPPAHALGGMDAELIDEEALTSLELELGLHRVRELPELFLGQSEFDCFSDLGSAPPAGSVSC

SEQ ID NO: 98 - protein, 274 aa, Artificial Sequence
  Description of Artificial Sequence: Synthetic polypeptide
SGLEMADHMMAMNHGRFPDGTNGLHHHPAHRMGMGQFPSPHHHQQQQPQHAFNALMGEHIHYGAGNMNATSGVRHAMGPGTVNGGHPPSALAPAARFNNSQFMGPPVASQGGSLPASMQLQKLNNQYFNHHPYPHNHYMPDLHPAAGHQMNGTNQHFRDCNPKHSGGSSTPGGSGGSSTPGGSGSSSGGGAGSSNSGGGSGSGNMPASVAHVPAAMLPPNVIDTDFIDEEVLMSLVIEMGLDRIKELPELWLGQNEFDFMTDFVCKQQPSRVSC

SEQ ID NO: 99 - protein, 275 aa, Artificial Sequence; identical to SEQ ID NO: 96
  Description of Artificial Sequence: Synthetic polypeptide

SEQ ID NO: 100 - protein, 184 aa, Artificial Sequence
  Description of Artificial Sequence: Synthetic polypeptide
AADHLMLAEGYRLVQRPPSAAAAHGPHALRTLPPYAGPGLDSGLRPRGAPLGPPPPRQPGALAYGAFGPPSSFQPFPAVPPPAAGIAHLQPVATPYPGRAAAPPNAPGGPPGPQPAPSAAAPPPPAHALGGMDAELIDEEALTSLELELGLHRVRELPELFLGQSEFDCFSDLGSAPPAGSVSC

SEQ ID NO: 101 - skipped

SEQ ID NO: 102 - DNA, 76 bp, Artificial Sequence
  Description of Artificial Sequence: Synthetic oligonucleotide
gttttagtactctggaaacagaatctactaaaacaaggcaaaatgccgtgtttatctcgtcaacttgttggcgaga

SEQ ID NO: 103 - protein, 1052 aa, Artificial Sequence
  Description of Artificial Sequence: Synthetic polypeptide
KRNYILGLAIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEEASKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPRIIKTIASKTQSIKKYSTDILGNLYEVKSKKHPQIIKKG

SEQ ID NO: 104 - protein, 1148 aa, Artificial Sequence
  Description of Artificial Sequence: Synthetic polypeptide
MAPKKKRKVGIHGVPAAKRNYILGLAIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEEASKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPRIIKTIASKTQSIKKYSTDILGNLYEVKSKKHPQIIKKGKRPAATKKAGQAKKKKGSYPYDVPDYALEDALDDFDLDMLGSDALDDFDLDMLGSDALDDFDLDMLGSDALDDFDLDML

SEQ ID NO: 105 - DNA, 21 bp, Artificial Sequence
  Description of Artificial Sequence: Synthetic oligonucleotide
tgacctagacagccttacata

SEQ ID NO: 106 - DNA, 21 bp, Homo sapiens
taaggctgtctaggtcaagtg

SEQ ID NO: 107 - DNA, 21 bp, Homo sapiens
aaggctgtctaggtcaagtgt

SEQ ID NO: 108 - DNA, 21 bp, Homo sapiens
gatgaagccgagaggatactg

SEQ ID NO: 109 - DNA, 21 bp, Homo sapiens
gctgatttgtattaggtacca

SEQ ID NO: 110 - DNA, 21 bp, Artificial Sequence
  Description of Artificial Sequence: Synthetic oligonucleotide
cttcgttatgtaaggctgtct

SEQ ID NO: 111 - DNA, 21 bp, Artificial Sequence
  Description of Artificial Sequence: Synthetic oligonucleotide
caagtgtaggagacacactgc

SEQ ID NO: 112 - protein, 1052 aa, Artificial Sequence; identical to SEQ ID NO: 103
  Description of Artificial Sequence: Synthetic polypeptide

SEQ ID NO: 113 - DNA, 21 bp, Homo sapiens
catgatccctagaaatggggt

SEQ ID NO: 114 - protein, 523 aa, Artificial Sequence
  Description of Artificial Sequence: Synthetic polypeptide
DALDDFDLDMLGSDALDDFDLDMLGSDALDDFDLDMLGSDALDDFDLDMLINSRSSGSPKKKRKVGSQYLPDTDDRHRIEEKRKRTYETFKSIMKKSPFSGPTDPRPPPRRIAVPSRSSASVPKPAPQPYPFTSSLSTINYDEFPTMVFPSGQISQASALAPAPPQVLPQAPAPAPAPAMVSALAQAPAPVPVLAPGPPQAVAPPAPKPTQAGEGTLSEALLQLQFDDEDLGALLGNSTDPAVFTDLASVDNSEFQQLLNQGIPVAPHTTEPMLMEYPEAITRLVTGAQRPPDPAPAPLGAPGLPNGLLSGDEDFSSIADMDFSALLGSGSGSRDSREGMFLPKPEAGSAISDVFEGREVCQPKRIRPFHPPGSPWANRPLPASLAPTPTGPVHEPVGSLTPAPVPQPLDPAPAVTPEASHLLEDPDEETSQAVKALREMADTVIPQKEEAAICGQMDLSHPPPRGHLDELTTTLESMTEDLNLDSPLTPELNEILDTFLNDECLLHAMHISTGLSIFDTSLF

SEQ ID NO: 115 - protein, 7 aa, Artificial Sequence
  Description of Artificial Sequence: Synthetic peptide
RSDNLVR

SEQ ID NO: 116 - protein, 7 aa, Artificial Sequence
  Description of Artificial Sequence: Synthetic peptide
REDNLHT

SEQ ID NO: 117 - protein, 7 aa, Artificial Sequence
  Description of Artificial Sequence: Synthetic peptide
RSDELVR

SEQ ID NO: 118 - protein, 7 aa, Artificial Sequence
  Description of Artificial Sequence: Synthetic peptide
QSGNLTE

SEQ ID NO: 119 - protein, 7 aa, Artificial Sequence
  Description of Artificial Sequence: Synthetic peptide
TSGHLVR

SEQ ID NO: 120 - protein, 7 aa, Artificial Sequence
  Description of Artificial Sequence: Synthetic peptide
QNSTLTE

SEQ ID NO: 121 - protein, 7 aa, Artificial Sequence
  Description of Artificial Sequence: Synthetic peptide
DPGALVR

SEQ ID NO: 122 - protein, 7 aa, Artificial Sequence
  Description of Artificial Sequence: Synthetic peptide
HRTTLTN

SEQ ID NO: 123 - protein, 7 aa, Artificial Sequence
  Description of Artificial Sequence: Synthetic peptide
QSGDLRR

SEQ ID NO: 124 - protein, 7 aa, Artificial Sequence
  Description of Artificial Sequence: Synthetic peptide
TSHSLTE

SEQ ID NO: 125 - protein, 7 aa, Artificial Sequence
  Description of Artificial Sequence: Synthetic peptide
THLDLIR

SEQ ID NO: 126 - protein, 7 aa, Artificial Sequence
  Description of Artificial Sequence: Synthetic peptide
QSSSLVR

SEQ ID NO: 127 - protein, 7 aa, Artificial Sequence
  Description of Artificial Sequence: Synthetic peptide
TSGNLVR

SEQ ID NO: 128 - protein, 7 aa, Artificial Sequence
  Description of Artificial Sequence: Synthetic peptide
RRDELNV

SEQ ID NO: 129 - protein, 7 aa, Artificial Sequence
  Description of Artificial Sequence: Synthetic peptide
RSDDLVR

SEQ ID NO: 130 - protein, 7 aa, Artificial Sequence
  Description of Artificial Sequence: Synthetic peptide
RSDHLTN

SEQ ID NO: 131 - protein, 176 aa, Artificial Sequence
  Description of Artificial Sequence: Synthetic polypeptide
LEPGEKPYKCPECGKSFSRSDNLVRHQRTHTGEKPYKCPECGKSFSREDNLHTHQRTHTGEKPYKCPECGKSFSRSDELVRHQRTHTGEKPYKCPECGKSFSQSGNLTEHQRTHTGEKPYKCPECGKSFSTSGHLVRHQRTHTGEKPYKCPECGKSFSQNSTLTEHQRTHTGKKTS

SEQ ID NO: 132 - protein, 176 aa, Artificial Sequence
  Description of Artificial Sequence: Synthetic polypeptide
LEPGEKPYKCPECGKSFSRSDNLVRHQRTHTGEKPYKCPECGKSFSHRTTLTNHQRTHTGEKPYKCPECGKSFSREDNLHTHQRTHTGEKPYKCPECGKSFSTSHSLTEHQRTHTGEKPYKCPECGKSFSQSSSLVRHQRTHTGEKPYKCPECGKSFSREDNLHTHQRTHTGKKTS

SEQ ID NO: 133 - protein, 176 aa, Artificial Sequence
  Description of Artificial Sequence: Synthetic polypeptide
LEPGEKPYKCPECGKSFSDPGALVRHQRTHTGEKPYKCPECGKSFSRSDNLVRHQRTHTGEKPYKCPECGKSFSQSGDLRRHQRTHTGEKPYKCPECGKSFSTHLDLIRHQRTHTGEKPYKCPECGKSFSTSGNLVRHQRTHTGEKPYKCPECGKSFSRSDNLVRHQRTHTGKKTS

SEQ ID NO: 134 - protein, 260 aa, Artificial Sequence
  Description of Artificial Sequence: Synthetic polypeptide
LEPGEKPYKCPECGKSFSRRDELNVHQRTHTGEKPYKCPECGKSFSRSDHLTNHQRTHTGEKPYKCPECGKSFSRSDDLVRHQRTHTGEKPYKCPECGKSFSRSDNLVRHQRTHTGEKPYKCPECGKSFSHRTTLTNHQRTHTGEKPYKCPECGKSFSREDNLHTHQRTHTGEKPYKCPECGKSFSTSHSLTEHQRTHTGEKPYKCPECGKSFSQSSSLVRHQRTHTGEKPYKCPECGKSFSREDNLHTHQRTHTGKKTS

SEQ ID NO: 135 - protein, 292 aa, Artificial Sequence
  Description of Artificial Sequence: Synthetic polypeptide
  MOD_RES (8)..(57): Any amino acid
  MISC_FEATURE (8)..(57): This region may encompass 1-50 residues
  MOD_RES (65)..(114): Any amino acid
  MISC_FEATURE (65)..(114): This region may encompass 1-50 residues
  MOD_RES (122)..(171): Any amino acid
  MISC_FEATURE (122)..(171): This region may encompass 1-50 residues
  MOD_RES (179)..(228): Any amino acid
  MISC_FEATURE (179)..(228): This region may encompass 1-50 residues
  MOD_RES (236)..(285): Any amino acid
  MISC_FEATURE (236)..(285): This region may encompass 1-50 residues
RSDNLVRXXXXXXXXXXXXXXXXXXXXXXXXXXXXXXXXXXXXXXXXXXXXXXXXXXREDNLHTXXXXXXXXXXXXXXXXXXXXXXXXXXXXXXXXXXXXXXXXXXXXXXXXXXRSDELVRXXXXXXXXXXXXXXXXXXXXXXXXXXXXXXXXXXXXXXXXXXXXXXXXXXQSGNLTEXXXXXXXXXXXXXXXXXXXXXXXXXXXXXXXXXXXXXXXXXXXXXXXXXXTSGHLVRXXXXXXXXXXXXXXXXXXXXXXXXXXXXXXXXXXXXXXXXXXXXXXXXXXQNSTLTE

SEQ ID NO: 136 - DNA, 18 bp, Homo sapiens
gaggatactgcagaggtc

SEQ ID NO: 137-140 - skipped (4 entries)

SEQ ID NO: 141 - protein, 7 aa, Artificial Sequence
  Description of Artificial Sequence: Synthetic peptide
RNDTLTE

SEQ ID NO: 142 - protein, 7 aa, Artificial Sequence
  Description of Artificial Sequence: Synthetic peptide
RSDNLVR

SEQ ID NO: 143 - protein, 7 aa, Artificial Sequence
  Description of Artificial Sequence: Synthetic peptide
RSDHLTT

SEQ ID NO: 144 - protein, 7 aa, Artificial Sequence
  Description of Artificial Sequence: Synthetic peptide
SPADLTR

SEQ ID NO: 145 - protein, 7 aa, Artificial Sequence
  Description of Artificial Sequence: Synthetic peptide
TSHSLTE

SEQ ID NO: 146 - protein, 7 aa, Artificial Sequence
  Description of Artificial Sequence: Synthetic peptide
QSGDLRR

SEQ ID NO: 147 - protein, 7 aa, Artificial Sequence
  Description of Artificial Sequence: Synthetic peptide
DPGALVR

SEQ ID NO: 148 - protein, 7 aa, Artificial Sequence
  Description of Artificial Sequence: Synthetic peptide
DPGHLVR

SEQ ID NO: 149 - protein, 7 aa, Artificial Sequence
  Description of Artificial Sequence: Synthetic peptide
RSDELVR

SEQ ID NO: 150 - protein, 7 aa, Artificial Sequence
  Description of Artificial Sequence: Synthetic peptide
DSGNLRV

SEQ ID NO: 151 - protein, 7 aa, Artificial Sequence
  Description of Artificial Sequence: Synthetic peptide
HKNALQN

SEQ ID NO: 152 - protein, 7 aa, Artificial Sequence
  Description of Artificial Sequence: Synthetic peptide
TSGELVR

SEQ ID NO: 153 - protein, 7 aa, Artificial Sequence
  Description of Artificial Sequence: Synthetic peptide
RSDKLVR

SEQ ID NO: 154 - protein, 7 aa, Artificial Sequence
  Description of Artificial Sequence: Synthetic peptide
QLAHLRA

SEQ ID NO: 155 - protein, 7 aa, Artificial Sequence
  Description of Artificial Sequence: Synthetic peptide
ERSHLRE

SEQ ID NO: 156 - protein, 7 aa, Artificial Sequence
  Description of Artificial Sequence: Synthetic peptide
TTGNLTV

SEQ ID NO: 157 - protein, 7 aa, Artificial Sequence
  Description of Artificial Sequence: Synthetic peptide
QRANLRA

SEQ ID NO: 158 - protein, 7 aa, Artificial Sequence
  Description of Artificial Sequence: Synthetic peptide
SKKALTE

SEQ ID NO: 159 - protein, 7 aa, Artificial Sequence
  Description of Artificial Sequence: Synthetic peptide
REDNLHT

SEQ ID NO: 160 - protein, 7 aa, Artificial Sequence
  Description of Artificial Sequence: Synthetic peptide
TKNSLTE

SEQ ID NO: 161 - protein, 7 aa, Artificial Sequence
  Description of Artificial Sequence: Synthetic peptide
RKDNLKN

SEQ ID NO: 162 - protein, 7 aa, Artificial Sequence
  Description of Artificial Sequence: Synthetic peptide
QSSNLVR

SEQ ID NO: 163 - protein, 7 aa, Artificial Sequence
  Description of Artificial Sequence: Synthetic peptide
QSSSLVR

SEQ ID NO: 164 - protein, 7 aa, Artificial Sequence
  Description of Artificial Sequence: Synthetic peptide
QAGHLAS

SEQ ID NO: 165 - protein, 176 aa, Artificial Sequence
  Description of Artificial Sequence: Synthetic polypeptide
LEPGEKPYKCPECGKSFSRNDTLTEHQRTHTGEKPYKCPECGKSFSDPGALVRHQRTHTGEKPYKCPECGKSFSTSGELVRHQRTHTGEKPYKCPECGKSFSRSDNLVRHQRTHTGEKPYKCPECGKSFSTSGELVRHQRTHTGEKPYKCPECGKSFSTKNSLTEHQRTHTGKKTS

SEQ ID NO: 166 - protein, 176 aa, Artificial Sequence
  Description of Artificial Sequence: Synthetic polypeptide
LEPGEKPYKCPECGKSFSRSDNLVRHQRTHTGEKPYKCPECGKSFSDPGHLVRHQRTHTGEKPYKCPECGKSFSRSDHLTTHQRTHTGEKPYKCPECGKSFSRSDELVRHQRTHTGEKPYKCPECGKSFSRSDKLVRHQRTHTGEKPYKCPECGKSFSTTGNLTVHQRTHTGKKTS

SEQ ID NO: 167 - protein, 176 aa, Artificial Sequence
  Description of Artificial Sequence: Synthetic polypeptide
LEPGEKPYKCPECGKSFSRSDHLTTHQRTHTGEKPYKCPECGKSFSRSDELVRHQRTHTGEKPYKCPECGKSFSRSDKLVRHQRTHTGEKPYKCPECGKSFSTTGNLTVHQRTHTGEKPYKCPECGKSFSQLAHLRAHQRTHTGEKPYKCPECGKSFSTKNSLTEHQRTHTGKKTS

SEQ ID NO: 168 - protein, 176 aa, Artificial Sequence
  Description of Artificial Sequence: Synthetic polypeptide
LEPGEKPYKCPECGKSFSSPADLTRHQRTHTGEKPYKCPECGKSFSDSGNLRVHQRTHTGEKPYKCPECGKSFSQLAHLRAHQRTHTGEKPYKCPECGKSFSQRANLRAHQRTHTGEKPYKCPECGKSFSREDNLHTHQRTHTGEKPYKCPECGKSFSRSDNLVRHQRTHTGKKTS

SEQ ID NO: 169 - protein, 260 aa, Artificial Sequence
  Description of Artificial Sequence: Synthetic polypeptide
LEPGEKPYKCPECGKSFSTSHSLTEHQRTHTGEKPYKCPECGKSFSHKNALQNHQRTHTGEKPYKCPECGKSFSERSHLREHQRTHTGEKPYKCPECGKSFSSKKALTEHQRTHTGEKPYKCPECGKSFSQRANLRAHQRTHTGEKPYKCPECGKSFSRKDNLKNHQRTHTGEKPYKCPECGKSFSQSSNLVRHQRTHTGEKPYKCPECGKSFSQSSSLVRHQRTHTGEKPYKCPECGKSFSQAGHLASHQRTHTGKKTS

SEQ ID NO: 170 - protein, 204 aa, Artificial Sequence
  Description of Artificial Sequence: Synthetic polypeptide
LEPGEKPYKCPECGKSFSQSGDLRRHQRTHTGEKPYKCPECGKSFSSPADLTRHQRTHTGEKPYKCPECGKSFSDSGNLRVHQRTHTGEKPYKCPECGKSFSQLAHLRAHQRTHTGEKPYKCPECGKSFSQRANLRAHQRTHTGEKPYKCPECGKSFSREDNLHTHQRTHTGEKPYKCPECGKSFSRSDNLVRHQRTHTGKKTS

SEQ ID NO: 171 - protein, 292 aa, Artificial Sequence
  Description of Artificial Sequence: Synthetic polypeptide
  MOD_RES (8)..(57): Any amino acid
  MISC_FEATURE (8)..(57): This region may encompass 1-50 residues
  MOD_RES (65)..(114): Any amino acid
  MISC_FEATURE (65)..(114): This region may encompass 1-50 residues
  MOD_RES (122)..(171): Any amino acid
  MISC_FEATURE (122)..(171): This region may encompass 1-50 residues
  MOD_RES (179)..(228): Any amino acid
  MISC_FEATURE (179)..(228): This region may encompass 1-50 residues
  MOD_RES (236)..(285): Any amino acid
  MISC_FEATURE (236)..(285): This region may encompass 1-50 residues
RNDTLTEXXXXXXXXXXXXXXXXXXXXXXXXXXXXXXXXXXXXXXXXXXXXXXXXXXDPGALVRXXXXXXXXXXXXXXXXXXXXXXXXXXXXXXXXXXXXXXXXXXXXXXXXXXTSGELVRXXXXXXXXXXXXXXXXXXXXXXXXXXXXXXXXXXXXXXXXXXXXXXXXXXRSDNLVRXXXXXXXXXXXXXXXXXXXXXXXXXXXXXXXXXXXXXXXXXXXXXXXXXXTSGELVRXXXXXXXXXXXXXXXXXXXXXXXXXXXXXXXXXXXXXXXXXXXXXXXXXXTKNSLTE

SEQ ID NO: 172-177 - skipped (6 entries)

SEQ ID NO: 178 - DNA, 49 bp, Artificial Sequence
  Description of Artificial Sequence: Synthetic oligonucleotide
gtgtgtatgctcaggggctgggaaaggaggggagggagctccggctcag

SEQ ID NO: 179 - DNA, 1644 bp, Artificial Sequence
  Description of Artificial Sequence: Synthetic polynucleotide
cgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttgttgtgctgtctcatcattttggcaaagaatt

SEQ ID NO: 180 - protein, 2009 aa, Homo sapiens
MEQTVLVPPGPDSFNFFTRESLAAIERRIAEEKAKNPKPDKKDDDENGPKPNSDLEAGKNLPFIYGDIPPEMVSEPLEDLDPYYINKKTFIVLNKGKAIFRFSATSALYILTPFNPLRKIAIKILVHSLFSMLIMCTILTNCVFMTMSNPPDWTKNVEYTFTGIYTFESLIKIIARGFCLEDFTFLRDPWNWLDFTVITFAYVTEFVDLGNVSALRTFRVLRALKTISVIPGLKTIVGALIQSVKKLSDVMILTVFCLSVFALIGLQLFMGNLRNKCIQWPPTNASLEEHSIEKNITVNYNGTLINETVFEFDWKSYIQDSRYHYFLEGFLDALLCGNSSDAGQCPEGYMCVKAGRNPNYGYTSFDTFSWAFLSLFRLMTQDFWENLYQLTLRAAGKTYMIFFVLVIFLGSFYLINLILAVVAMAYEEQNQATLEEAEQKEAEFQQMIEQLKKQQEAAQQAATATASEHSREPSAAGRLSDSSSEASKLSSKSAKERRNRRKKRKQKEQSGGEEKDEDEFQKSESEDSIRRKGFRFSIEGNRLTYEKRYSSPHQSLLSIRGSLFSPRRNSRTSLFSFRGRAKDVGSENDFADDEHSTFEDNESRRDSLFVPRRHGERRNSNLSQTSRSSRMLAVFPANGKMHSTVDCNGVVSLVGGPSVPTSPVGQLLPEVIIDKPATDDNGTTTETEMRKRRSSSFHVSMDFLEDPSQRQRAMSIASILTNTVEELEESRQKCPPCWYKFSNIFLIWDCSPYWLKVKHVVNLVVMDPFVDLAITICIVLNTLFMAMEHYPMTDHFNNVLTVGNLVFTGIFTAEMFLKIIAMDPYYYFQEGWNIFDGFIVTLSLVELGLANVEGLSVLRSFRLLRVFKLAKSWPTLNMLIKIIGNSVGALGNLTLVLAIIVFIFAVVGMQLFGKSYKDCVCKIASDCQLPRWHMNDFFHSFLIVFRVLCGEWIETMWDCMEVAGQAMCLTVFMMVMVIGNLVVLNLFLALLLSSFSADNLAATDDDNEMNNLQIAVDRMHKGVAYVKRKIYEFIQQSFIRKQKILDEIKPLDDLNNKKDSCMSNHTAEIGKDLDYLKDVNGTTSGIGTGSSVEKYIIDESDYMSFINNPSLTVTVPIAVGESDFENLNTEDFSSESDLEESKEKLNESSSSSEGSTVDIGAPVEEQPVVEPEETLEPEACFTEGCVQRFKCCQINVEEGRGKQWWNLRRTCFRIVEHNWFETFIVFMILLSSGALAFEDIYIDQRKTIKTMLEYADKVFTYIFILEMLLKWVAYGYQTYFTNAWCWLDFLIVDVSLVSLTANALGYSELGAIKSLRTLRALRPLRALSRFEGMRVVVNALLGAIPSIMNVLLVCLIFWLIFSIMGVNLFAGKFYHCINTTTGDRFDIEDVNNHTDCLKLIERNETARWKNVKVNFDNVGFGYLSLLQVATFKGWMDIMYAAVDSRNVELQPKYEESLYMYLYFVIFIIFGSFFTLNLFIGVIIDNFNQQKKKFGGQDIFMTEEQKKYYNAMKKLGSKKPQKPIPRPGNKFQGMVFDFVTRQVFDISIMILICLNMVTMMVETDDQSEYVTTILSRINLVFIVLFTGECVLKLISLRHYYFTIGWNIFDFVVVILSIVGMFLAELIEKYFVSPTLFRVIRLARIGRILRLIKGAKGIRTLLFALMMSLPALFNIGLLLFLVMFIYAIFGMSNFAYVKREVGIDDMFNFETFGNSMICLFQITTSAGWDGLLAPILNSKPPDCDPNKVNPGSSVKGDCGNPSVGIFFFVSYIIISFLVVVNMYIAVILENFSVATEESAEPLSEDDFEMFYEVWEKFDPDATQFMEFEKLSQFAAALEPPLNLPQPNKLQLIAMDLPMVSGDRIHCLDILFAFTKRVLGESGEMDALRIQMEERFMASNPSKVSYQPITTTLKRKQEEVSAVIIQRAYRRHLLKRTVKQASFTYNKNKIKGGANLLIKEDMIIDRINENSITEKTDLTMSTAACPPSYDRVTKPIVEKHEQEGKDEKAKGK

SEQ ID NO: 181 - protein, 593 aa, Homo sapiens
MWTLVSWVALTAGLVAGTRCPDGQFCPVACCLDPGGASYSCCRPLLDKWPTTLSRHLGGPCQVDAHCSAGHSCIFTVSGTSSCCPFPEAVACGDGHHCCPRGFHCSADGRSCFQRSGNNSVGAIQCPDSQFECPDFSTCCVMVDGSWGCCPMPQASCCEDRVHCCPHGAFCDLVHTRCITPTGTHPLAKKLPAQRTNRAVALSSSVMCPDARSRCPDGSTCCELPSGKYGCCPMPNATCCSDHLHCCPQDTVCDLIQSKCLSKENATTDLLTKLPAHTVGDVKCDMEVSCPDGYTCCRLQSGAWGCCPFTQAVCCEDHIHCCPAGFTCDTQKGTCEQGPHQVPWMEKAPAHLSLPDPQALKRDVPCDNVSSCPSSDTCCQLTSGEWGCCPIPEAVCCSDHQHCCPQGYTCVAEGQCQRGSEIVAGLEKMPARRASLSHPRDIGCDQHTSCPVGQTCCPSLGGSWACCQLPHAVCCEDRQHCCPAGYTCNVKARSCEKEVVSAQPATFLARSPHVGVKDVECGEGHFCHDNQTCCRDNRQGWACCPYRQGVCCADRRHCCPAGFRCAARGTKCLRREAPRWDAPLRDPALRQLL

SEQ ID NO: 182 - DNA, 56 bp, Artificial Sequence
  Description of Artificial Sequence: Synthetic oligonucleotide
gtaaggtaagaattgaatttctcagttgaaggatgcttacactcttgtccatctag

SEQ ID NO: 183 - DNA, 2051 bp, Artificial Sequence
  Description of Artificial Sequence: Synthetic polynucleotide
ggaggaagccatcaactaaactacaatgactgtaagatacaaaattgggaatggtaacatattttgaagttctgttgacataaagaatcatgatattaatgcccatggaaatgaaagggcgatcaacactatggtttgaaaagggggaaattgtagagcacagatgtgttcgtgtggcagtgtgctgtctctagcaatactcagagaagagagagaacaatgaaattctgattggccccagtgtgagcccagatgaggttcagctgccaactttctctttcacatcttatgaaagtcatttaagcacaactaactttttttttttttttttttttttgagacagagtcttgctctgttgcccaggacagagtgcagtagtgactcaatctcggctcactgcagcctccacctcctaggctcaaacggtcctcctgcatcagcctcccaagtagctggaattacaggagtggcccaccatgcccagctaatttttgtatttttaatagatacgggggtttcaccatatcacccaggctggtctcgaactcctggcctcaagtgatccacctgcctcggcctcccaaagtgctgggattataggcgtcagccactatgcccaacccgaccaaccttttttaaaataaatatttaaaaaattggtatttcacatatatactagtatttacatttatccacacaaaacggacgggcctccgctgaaccagtgaggccccagacgtgcgcataaataacccctgcgtgctgcaccacctggggagagggggaggaccacggtaaatggagcgagcgcatagcaaaagggacgcggggtccttttctctgccggtggcactgggtagctgtggccaggtgtggtactttgatggggcccagggctggagctcaaggaagcgtcgcagggtcacagatctgggggaaccccggggaaaagcactgaggcaaaaccgccgctcgtctcctacaatatatgggagggggaggttgagtacgttctggattactcataagaccttttttttttccttccgggcgcaaaaccgtgagctggatttataatcgccctataaagctccagaggcggtcaggcacctgcagaggagccccgccgctccgccgactagctgcccccgcgagcaacggcctcgtgatttccccgccgatccggtccccgcctccccactctgcccccgcctaccccggagccgtgcagccgcctctccgaatctctctcttctcctggcgctcgcgtgcgagagggaactagcgagaacgaggaagcagctggaggtgacgccgggcagattacgcctgtcagggccgagccgagcggatcgctgggcgctgtgcagaggaaaggcgggagtgcccggctcgctgtcgcagagccgaggtgggtaagctagcgaccacctggacttcccagcgcccaaccgtggcttttcagccaggtcctctcctcccgcggcttctcaaccaaccccatcccagcgccggccacccaacctcccgaaatgagtgcttcctgccccagcagccgaaggcgctactaggaacggtaacctgttacttttccaggggccgtagtcgacccgctgcccgagttgctgtgcgactgcgcgcgcggggctagagtgcaaggtgactgtggttcttctctggccaagtccgagggagaacgtaaagatatgggcctttttccccctctcaccttgtctcaccaaagtccctagtccccggagcagttagcctctttctttccagggaattagccagacacaacaacgggaaccagacaccgaaccagacatgcccgccccgtgcgccctccccgctcgctgcctttcctccctcttgtctctccagagccggatcttcaaggggagcctccgtgcccccggctgctcagtccctccggtgtgcaggaccccggaagtcctccccgcacagctctcgcttctctttgcagcctgtttctgcgccggaccagtcgaggactctggacagtagaggccccgggacgaccgagctg

SEQ ID NO: 184 - DNA, 1878 bp, Artificial Sequence
  Description of Artificial Sequence: Synthetic polynucleotide
tcaacagggggacacttgggaaagaaggatggggacagagccgagaggactgttacacattagagaaacatcagtgactgtgccagctttggggtagactgcacaaaagccctgaggcagcacaggcaggatccagtctgctggtcccaggaagctaaccgtctcagacagagcacaaagcaccgagacatgtgccacaaggcttgtgtagagaggtcagaggacagcgtacaggtcccagagatcaaactcaacctcaccaggcttggcagcaagcctttaccaacccacccccaccccacccaccctgcacgcgcccctctcccctccccatggtctcccatggctatctcacttggccctaaaatgtttaaggatgacactggctgctgagtggaaatgagacagcagaagtcaacagtagattttaggaaagccagagaaaaaggcttgtgctgtttttagaaagccaagggacaagctaagatagggcccaagtaatgctagtatttacatttatccacacaaaacggacgggcctccgctgaaccagtgaggccccagacgtgcgcataaataacccctgcgtgctgcaccacctggggagagggggaggaccacggtaaatggagcgagcgcatagcaaaagggacgcggggtccttttctctgccggtggcactgggtagctgtggccaggtgtggtactttgatggggcccagggctggagctcaaggaagcgtcgcagggtcacagatctgggggaaccccggggaaaagcactgaggcaaaaccgccgctcgtctcctacaatatatgggagggggaggttgagtacgttctggattactcataagaccttttttttttccttccgggcgcaaaaccgtgagctggatttataatcgccctataaagctccagaggcggtcaggcacctgcagaggagccccgccgctccgccgactagctgcccccgcgagcaacggcctcgtgatttccccgccgatccggtccccgcctccccactctgcccccgcctaccccggagccgtgcagccgcctctccgaatctctctcttctcctggcgctcgcgtgcgagagggaactagcgagaacgaggaagcagctggaggtgacgccgggcagattacgcctgtcagggccgagccgagcggatcgctgggcgctgtgcagaggaaaggcgggagtgcccggctcgctgtcgcagagccgaggtgggtaagctagcgaccacctggacttcccagcgcccaaccgtggcttttcagccaggtcctctcctcccgcggcttctcaaccaaccccatcccagcgccggccacccaacctcccgaaatgagtgcttcctgccccagcagccgaaggcgctactaggaacggtaacctgttacttttccaggggccgtagtcgacccgctgcccgagttgctgtgcgactgcgcgcgcggggctagagtgcaaggtgactgtggttcttctctggccaagtccgagggagaacgtaaagatatgggcctttttccccctctcaccttgtctcaccaaagtccctagtccccggagcagttagcctctttctttccagggaattagccagacacaacaacgggaaccagacaccgaaccagacatgcccgccccgtgcgccctccccgctcgctgcctttcctccctcttgtctctccagagccggatcttcaaggggagcctccgtgcccccggctgctcagtccctccggtgtgcaggaccccggaagtcctccccgcacagctctcgcttctctttgcagcctgtttctgcgccggaccagtcgaggactctggacagtagaggccccgggacgaccgagctg

SEQ ID NO: 185 - DNA, 681 bp, Artificial Sequence
  Description of Artificial Sequence: Synthetic polynucleotide
ggaggaagccatcaactaaactacaatgactgtaagatacaaaattgggaatggtaacatattttgaagttctgttgacataaagaatcatgatattaatgcccatggaaatgaaagggcgatcaacactatggtttgaaaagggggaaattgtagagcacagatgtgttcgtgtggcagtgtgctgtctctagcaatactcagagaagagagagaacaatgaaattctgattggccccagtgtgagcccagatgaggttcagctgccaactttctctttcacatcttatgaaagtcatttaagcacaactaactttttttttttttttttttttttgagacagagtcttgctctgttgcccaggacagagtgcagtagtgactcaatctcggctcactgcagcctccacctcctaggctcaaacggtcctcctgcatcagcctcccaagtagctggaattacaggagtggcccaccatgcccagctaatttttgtatttttaatagatacgggggtttcaccatatcacccaggctggtctcgaactcctggcctcaagtgatccacctgcctcggcctcccaaagtgctgggattataggcgtcagccactatgcccaacccgaccaaccttttttaaaataaatatttaaaaaattggtatttcacatatatactagt

SEQ ID NO: 186 - DNA, 1335 bp, Artificial Sequence
  Description of Artificial Sequence: Synthetic polynucleotide
gagtaattcatacaaaaggactcgcccctgccttggggaatcccagggaccgtcgttaaactcccactaacgtagaacccagagatcgctgcgttcccgccccctcacccgcccgctctcgtcatcactgaggtggagaagagcatgcgtgaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacgcccctggctgcagtacgtgattcttgatcccgagcttcgggttggaagtgggtgggagagttcgaggccttgcgcttaaggagccccttcgcctcgtgcttgagttgaggcctggcttgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtga

SEQ ID NO: 187 - DNA, 1366 bp, Artificial Sequence
  Description of Artificial Sequence: Synthetic polynucleotide
gagtttactccctatcagtgatagagaacgtatgtcgagtttactccctatcagtgatagagaacgatgtcgagtttactccctatcagtgatagagaacgtatgtcgagtttactccctatcagtgatagagaacgtatgtcgagtttactccctatcagtgatagagaacgtatgtcgagtttatccctatcagtgatagagaacgtatgtcgagtttactccctatcagtgatagagaacgtatgtcgaggtaggcgtgtacggtgggaggcctatataagcagagctcgtttagtgaaccgtcagatcgccgaattcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtccggactcagatctcgagaggaggaggaggagacagacagcaggatgccccacctcgacagccccggcagctcccagccgagacgctccttcctctcaagggtgatcagggcagctctaccgttgcagctgcttctgctgctgctgctgctcctggcctgcctgctacctgcctctgaagatgactacagctgcacccaggccaacaactttgcccgatccttctaccccatgctgcggtacaccaacgggccacctcccacctagactagtaataaaagatctttattttcattagatctgtgtgttggttttttgtgtg

SEQ ID NO: 188 - DNA, 315 bp, Artificial Sequence
  Description of Artificial Sequence: Synthetic polynucleotide
gagtttactccctatcagtgatagagaacgtatgtcgagtttactccctatcagtgatagagaacgatgtcgagtttactccctatcagtgatagagaacgtatgtcgagtttactccctatcagtgatagagaacgtatgtcgagtttactccctatcagtgatagagaacgtatgtcgagtttatccctatcagtgatagagaacgtatgtcgagtttactccctatcagtgatagagaacgtatgtcgaggtaggcgtgtacggtgggaggcctatataagcagagctcgtttagtgaaccgtcagatcgcc

SEQ ID NO: 189 - skipped

SEQ ID NO: 190 - DNA, 22 bp, Artificial Sequence
  Description of Artificial Sequence: Synthetic primer
tgtctcggcattgagaacattc

SEQ ID NO: 191 - DNA, 21 bp, Artificial Sequence
  Description of Artificial Sequence: Synthetic primer
attggtgggaggccattgtat

SEQ ID NO: 192 - DNA, 20 bp, Artificial Sequence
  Description of Artificial Sequence: Synthetic primer
accacagtccatgccatcac

SEQ ID NO: 193 - DNA, 20 bp, Artificial Sequence
  Description of Artificial Sequence: Synthetic primer
tccaccaccctgttgctgta

SEQ ID NO: 194 - skipped

SEQ ID NO: 195 - DNA, 21 bp, Homo sapiens
cactcattgaggacagaagca

SEQ ID NO: 196 - DNA, 21 bp, Homo sapiens
acaaagtggagagactacccg

SEQ ID NO: 197 - DNA, 21 bp, Homo sapiens
ggtacgggcaaagatttcttg

SEQ ID NO: 198 - DNA, 21 bp, Homo sapiens
tttgcccgtaccaaagtcttg

SEQ ID NO: 199 - DNA, 21 bp, Homo sapiens
tcttcagccacaaaaaaaaaa

SEQ ID NO: 200 - DNA, 21 bp, Homo sapiens
gtgtgcaacccatgaggtcgc

SEQ ID NO: 201 - DNA, 21 bp, Homo sapiens
acacaatgagccacctacaag

SEQ ID NO: 202 - DNA, 21 bp, Homo sapiens
gtggctcattgtgtgtgtgcc

SEQ ID NO: 203 - DNA, 21 bp, Homo sapiens
agaaagctgatacagatacaa

SEQ ID NO: 204 - skipped

SEQ ID NO: 205 - DNA, 21 bp, Homo sapiens
aaaccagcaacaaacagtata

SEQ ID NO: 206 - DNA, 21 bp, Homo sapiens
gagaatcatctaggtcaggac

SEQ ID NO: 207 - DNA, 21 bp, Homo sapiens
ttctcagttttgaaattaaaa

SEQ ID NO: 208 - DNA, 21 bp, Homo sapiens
catatccctgcaggttcagaa

SEQ ID NO: 209 - DNA, 21 bp, Homo sapiens
tggattctcttctgaacctgc

SEQ ID NO: 210 - DNA, 21 bp, Homo sapiens
agagagagagagagagagaga

SEQ ID NO: 211 - DNA, 21 bp, Homo sapiens
tggtctcattctttttgtggg

SEQ ID NO: 212-223 - skipped (12 entries)

SEQ ID NO: 224 - DNA, 21 bp, Homo sapiens
tgttcctccagattaacactt

SEQ ID NO: 225 - DNA, 21 bp, Homo sapiens
attacagttctgtcagcatgc

SEQ ID NO: 226 - DNA, 21 bp, Homo sapiens
atcatctgtaaccatcaagga

SEQ ID NO: 227 - DNA, 21 bp, Homo sapiens
tcctgcctacttagtttcaag

SEQ ID NO: 228 - DNA, 21 bp, Homo sapiens
tgctgaggcaggacacagtgt

SEQ ID NO: 229 - DNA, 21 bp, Homo sapiens
acaaagtaagtgtcagtgtgg

SEQ ID NO: 230 - DNA, 21 bp, Homo sapiens
ctgacacttactttgtctaaa

SEQ ID NO: 231 - DNA, 21 bp, Homo sapiens
ataatagttgtgtctttataa

SEQ ID NO: 232 - DNA, 21 bp, Homo sapiens
cgatattttcatggattcctt

SEQ ID NO: 233 - DNA, 21 bp, Homo sapiens
aaaactggaaccgcattccca

SEQ ID NO: 234 - DNA, 21 bp, Homo sapiens
tgtacaagcagggctgcaaag

SEQ ID NO: 235 - DNA, 21 bp, Homo sapiens
aaaggggaatgggaacacccg

SEQ ID NO: 236 - DNA, 21 bp, Homo sapiens
atgttcaaggtgcagaaggaa

SEQ ID NO: 237 - DNA, 21 bp, Homo sapiens
ttcaacaagctcccaagaagt

SEQ ID NO: 238 - DNA, 21 bp, Homo sapiens
gttaacaaatacactaaacac

SEQ ID NO: 239 - skipped

SEQ ID NO: 240 - DNA, 21 bp, Homo sapiens
aaaaccgtcaaccccatacag

SEQ ID NO: 241 - DNA, 21 bp, Homo sapiens
aggaatcacttgtcagaccta

SEQ ID NO: 242 - DNA, 21 bp, Homo sapiens
gagactgtgcgtataaaggca

SEQ ID NO: 243 - DNA, 21 bp, Homo sapiens
tactgatacaggaactgtgcc

SEQ ID NO: 244 - DNA, 21 bp, Homo sapiens
cttgtcatgaaacatgagcta

SEQ ID NO: 245 - DNA, 21 bp, Homo sapiens
tatctgtattccttttatttt

SEQ ID NO: 246 - DNA, 21 bp, Homo sapiens
ataaatggtaattaaaatgtg

SEQ ID NO: 247 - DNA, 21 bp, Homo sapiens
tgtttgctcaaacgtgcacca

SEQ ID NO: 248 - DNA, 21 bp, Homo sapiens
aaatatgtaccacaagaaatg

SEQ ID NO: 249 - DNA, 21 bp, Homo sapiens
tatctggtttctctcactgct

SEQ ID NO: 250 - DNA, 21 bp, Homo sapiens
aaataagacatgaaaacaaga

SEQ ID NO: 251 - DNA, 21 bp, Homo sapiens
attgcaaagcataatttggat

SEQ ID NO: 252 - DNA, 21 bp, Homo sapiens
caaactcccagcctgcctggc

SEQ ID NO: 253 - DNA, 18 bp, Homo sapiens
ccagcactggtgcttcgt

SEQ ID NO: 254 - DNA, 18 bp, Homo sapiens
aaggctgtctaggtcaag

SEQ ID NO: 255 - skipped

SEQ ID NO: 256 - DNA, 24 bp, Homo sapiens
ctaggtcaagtgtaggagacacac

SEQ ID NO: 257 - DNA, 18 bp, Homo sapiens
ggtcaagtgtaggagaca

SEQ ID NO: 258 - DNA, 18 bp, Homo sapiens
caagtgtaggagacacac

SEQ ID NO: 259 - DNA, 24 bp, Homo sapiens
agtgtaggagacacactgctggcc

SEQ ID NO: 260 - DNA, 18 bp, Homo sapiens
agtgtaggagacacactg

SEQ ID NO: 261 - DNA, 18 bp, Homo sapiens
acttgacctagacagcct

SEQ ID NO: 262 - DNA, 21 bp, Homo sapiens
aggagacacactgctggcctg

SEQ ID NO: 263 - skipped

SEQ ID NO: 264 - DNA, 18 bp, Homo sapiens
tgaataactcattagtga

SEQ ID NO: 265 - DNA, 18 bp, Homo sapiens
aaagtacattaggctaat

SEQ ID NO: 266-267 - skipped (2 entries)

SEQ ID NO: 268 - protein, 231 aa, Artificial Sequence
  Description of Artificial Sequence: Synthetic polypeptide
MAPKKKRKVGIHGVPAALEPGEKPYKCPECGKSFSDPGHLVRHQRTHTGEKPYKCPECGKSFSTKNSLTEHQRTHTGEKPYKCPECGKSFSRNDALTEHQRTHTGEKPYKCPECGKSFSERSHLREHQRTHTGEKPYKCPECGKSFSSKKHLAEHQRTHTGEKPYKCPECGKSFSTHLDLIRHQRTHTGEKPYKCPECGKSFSQSGNLTEHQRTHTGKKTSKRPAATKKAG

SEQ ID NO: 269 - protein, 203 aa, Artificial Sequence
  Description of Artificial Sequence: Synthetic polypeptide
MAPKKKRKVGIHGVPAALEPGEKPYKCPECGKSFSSRRTCRAHQRTHTGEKPYKCPECGKSFSTTGALTEHQRTHTGEKPYKCPECGKSFSRSDELVRHQRTHTGEKPYKCPECGKSFSRNDALTEHQRTHTGEKPYKCPECGKSFSQSGDLRRHQRTHTGEKPYKCPECGKSFSTSHSLTEHQRTHTGKKTSKRPAATKKAG

SEQ ID NO: 270 - protein, 203 aa, Artificial Sequence
  Description of Artificial Sequence: Synthetic polypeptide
MAPKKKRKVGIHGVPAALEPGEKPYKCPECGKSFSRKDNLKNHQRTHTGEKPYKCPECGKSFSDPGALVRHQRTHTGEKPYKCPECGKSFSREDNLHTHQRTHTGEKPYKCPECGKSFSDPGALVRHQRTHTGEKPYKCPECGKSFSTSGELVRHQRTHTGEKPYKCPECGKSFSRKDNLKNHQRTHTGKKTSKRPAATKKAG

SEQ ID NO: 271 - protein, 272 aa, Artificial Sequence
  Description of Artificial Sequence: Synthetic polypeptide
MAPKKKRKVGIHGVPAALEPGEKPYKCPECGKSFSRSDNLVRHQRTHTGEKPYKCPECGKSFSREDNLHTHQRTHTGEKPYKCPECGKSFSRSDELVRHQRTHTGEKPYKCPECGKSFSQSGNLTEHQRTHTGEKPYKCPECGKSFSTSGHLVRHQRTHTGEKPYKCPECGKSFSQNSTLTEHQRTHTGKKTSKRPAATKKAGQAKKKKGSYPYDVPDYALEDALDDFDLDMLGSDALDDFDLDMLGSDALDDFDLDMLGSDALDDFDLDML

SEQ ID NO: 272 - protein, 328 aa, Artificial Sequence
  Description of Artificial Sequence: Synthetic polypeptide
MAPKKKRKVGIHGVPAALEPGEKPYKCPECGKSFSSKKALTEHQRTHTGEKPYKCPECGKSFSSPADLTRHQRTHTGEKPYKCPECGKSFSRSDNLVRHQRTHTGEKPYKCPECGKSFSREDNLHTHQRTHTGEKPYKCPECGKSFSRSDELVRHQRTHTGEKPYKCPECGKSFSQSGNLTEHQRTHTGEKPYKCPECGKSFSTSGHLVRHQRTHTGEKPYKCPECGKSFSQNSTLTEHQRTHTGKKTSKRPAATKKAGQAKKKKGSYPYDVPDYALEDALDDFDLDMLGSDALDDFDLDMLGSDALDDFDLDMLGSDALDDFDLDML

SEQ ID NO: 273 - protein, 203 aa, Artificial Sequence
  Description of Artificial Sequence: Synthetic polypeptide
MAPKKKRKVGIHGVPAALEPGEKPYKCPECGKSFSSPADLTRHQRTHTGEKPYKCPECGKSFSRSDNLVRHQRTHTGEKPYKCPECGKSFSREDNLHTHQRTHTGEKPYKCPECGKSFSRSDELVRHQRTHTGEKPYKCPECGKSFSQSGNLTEHQRTHTGEKPYKCPECGKSFSTSGHLVRHQRTHTGKKTSKRPAATKKAG

SEQ ID NO: 274 - protein, 203 aa, Artificial Sequence
  Description of Artificial Sequence: Synthetic polypeptide
MAPKKKRKVGIHGVPAALEPGEKPYKCPECGKSFSSKKALTEHQRTHTGEKPYKCPECGKSFSSPADLTRHQRTHTGEKPYKCPECGKSFSRSDNLVRHQRTHTGEKPYKCPECGKSFSREDNLHTHQRTHTGEKPYKCPECGKSFSRSDELVRHQRTHTGEKPYKCPECGKSFSQSGNLTEHQRTHTGKKTSKRPAATKKAG

SEQ ID NO: 275 - protein, 259 aa, Artificial Sequence
  Description of Artificial Sequence: Synthetic polypeptide
MAPKKKRKVGIHGVPAALEPGEKPYKCPECGKSFSDCRDLARHQRTHTGEKPYKCPECGKSFSRNDALTEHQRTHTGEKPYKCPECGKSFSRNDALTEHQRTHTGEKPYKCPECGKSFSSPADLTRHQRTHTGEKPYKCPECGKSFSDPGNLVRHQRTHTGEKPYKCPECGKSFSQRAHLERHQRTHTGEKPYKCPECGKSFSQSSSLVRHQRTHTGEKPYKCPECGKSFSHRTTLTNHQRTHTGKKTSKRPAATKKAG

SEQ ID NO: 276 - protein, 203 aa, Artificial Sequence
  Description of Artificial Sequence: Synthetic polypeptide
MAPKKKRKVGIHGVPAALEPGEKPYKCPECGKSFSRNDALTEHQRTHTGEKPYKCPECGKSFSSPADLTRHQRTHTGEKPYKCPECGKSFSDPGNLVRHQRTHTGEKPYKCPECGKSFSQRAHLERHQRTHTGEKPYKCPECGKSFSQSSSLVRHQRTHTGEKPYKCPECGKSFSHRTTLTNHQRTHTGKKTSKRPAATKKAG

SEQ ID NO: 277 - protein, 203 aa, Artificial Sequence
  Description of Artificial Sequence: Synthetic polypeptide
MAPKKKRKVGIHGVPAALEPGEKPYKCPECGKSFSTKNSLTEHQRTHTGEKPYKCPECGKSFSRADNLTEHQRTHTGEKPYKCPECGKSFSQLAHLRAHQRTHTGEKPYKCPECGKSFSTKNSLTEHQRTHTGEKPYKCPECGKSFSQAGHLASHQRTHTGEKPYKCPECGKSFSTHLDLIRHQRTHTGKKTSKRPAATKKAG

SEQ ID NO: 278 - protein, 231 aa, Artificial Sequence
  Description of Artificial Sequence: Synthetic polypeptide
MAPKKKRKVGIHGVPAALEPGEKPYKCPECGKSFSRNDALTEHQRTHTGEKPYKCPECGKSFSDPGHLVRHQRTHTGEKPYKCPECGKSFSTSGELVRHQRTHTGEKPYKCPECGKSFSTHLDLIRHQRTHTGEKPYKCPECGKSFSSKKALTEHQRTHTGEKPYKCPECGKSFSQLAHLRAHQRTHTGEKPYKCPECGKSFSRSDHLTNHQRTHTGKKTSKRPAATKKAG

SEQ ID NO: 279 - protein, 272 aa, Artificial Sequence
  Description of Artificial Sequence: Synthetic polypeptide
MAPKKKRKVGIHGVPAALEPGEKPYKCPECGKSFSRSDNLVRHQRTHTGEKPYKCPECGKSFSHRTTLTNHQRTHTGEKPYKCPECGKSFSREDNLHTHQRTHTGEKPYKCPECGKSFSTSHSLTEHQRTHTGEKPYKCPECGKSFSQSSSLVRHQRTHTGEKPYKCPECGKSFSREDNLHTHQRTHTGKKTSKRPAATKKAGQAKKKKGSYPYDVPDYALEDALDDFDLDMLGSDALDDFDLDMLGSDALDDFDLDMLGSDALDDFDLDML

SEQ ID NO: 280 - protein, 272 aa, Artificial Sequence
  Description of Artificial Sequence: Synthetic polypeptide
MAPKKKRKVGIHGVPAALEPGEKPYKCPECGKSFSDPGALVRHQRTHTGEKPYKCPECGKSFSRSDNLVRHQRTHTGEKPYKCPECGKSFSQSGDLRRHQRTHTGEKPYKCPECGKSFSTHLDLIRHQRTHTGEKPYKCPECGKSFSTSGNLVRHQRTHTGEKPYKCPECGKSFSRSDNLVRHQRTHTGKKTSKRPAATKKAGQAKKKKGSYPYDVPDYALEDALDDFDLDMLGSDALDDFDLDMLGSDALDDFDLDMLGSDALDDFDLDML

SEQ ID NO: 281 - protein, 203 aa, Artificial Sequence
  Description of Artificial Sequence: Synthetic polypeptide
MAPKKKRKVGIHGVPAALEPGEKPYKCPECGKSFSQAGHLASHQRTHTGEKPYKCPECGKSFSREDNLHTHQRTHTGEKPYKCPECGKSFSTSGNLTEHQRTHTGEKPYKCPECGKSFSTHLDLIRHQRTHTGEKPYKCPECGKSFSQKSSLIAHQRTHTGEKPYKCPECGKSFSQAGHLASHQRTHTGKKTSKRPAATKKAG

SEQ ID NO: 282 - protein, 203 aa, Artificial Sequence
  Description of Artificial Sequence: Synthetic polypeptide
MAPKKKRKVGIHGVPAALEPGEKPYKCPECGKSFSTTGNLTVHQRTHTGEKPYKCPECGKSFSTSGELVRHQRTHTGEKPYKCPECGKSFSREDNLHTHQRTHTGEKPYKCPECGKSFSTSGNLTEHQRTHTGEKPYKCPECGKSFSQSSSLVRHQRTHTGEKPYKCPECGKSFSQRANLRAHQRTHTGKKTSKRPAATKKAG

SEQ ID NO: 283 - DNA, 20 bp, Artificial Sequence
  Description of Artificial Sequence: Synthetic primer
ggtcacgtacagcttcgcat

SEQ ID NO: 284 - DNA, 20 bp, Artificial Sequence
  Description of Artificial Sequence: Synthetic primer
ctggtttctggctcgtggag

SEQ ID NO: 285 - DNA, 19 bp, Artificial Sequence
  Description of Artificial Sequence: Synthetic primer
aagccccaaagccaagcag

SEQ ID NO: 286 - DNA, 19 bp, Artificial Sequence
  Description of Artificial Sequence: Synthetic primer
aggtgtggcattgaaacgg

SEQ ID NO: 287 - DNA, 20 bp, Artificial Sequence
  Description of Artificial Sequence: Synthetic primer
atggtcagttctgccctgtg

SEQ ID NO: 288 - DNA, 21 bp, Artificial Sequence
  Description of Artificial Sequence: Synthetic primer
cggtaaagatgcaggagtggc

SEQ ID NO: 289 - DNA, 20 bp, Artificial Sequence
  Description of Artificial Sequence: Synthetic primer
tgacaatgggcagaacgaat

SEQ ID NO: 290 - DNA, 20 bp, Artificial Sequence
  Description of Artificial Sequence: Synthetic primer
tgcagcactctgttgacgtt

SEQ ID NO: 291 - DNA, 20 bp, Artificial Sequence
  Description of Artificial Sequence: Synthetic primer
tgttgccactggtgctaaag

SEQ ID NO: 292 - DNA, 20 bp, Artificial Sequence
  Description of Artificial Sequence: Synthetic primer
acagcagtcttctccgcttc

SEQ ID NO: 293 - DNA, 20 bp, Artificial Sequence
  Description of Artificial Sequence: Synthetic primer
caaaaaagccacaaaagcct

SEQ ID NO: 294 - DNA, 20 bp, Artificial Sequence
  Description of Artificial Sequence: Synthetic primer
ttagctccgcaagaaacatc

SEQ ID NO: 295 - protein, 667 aa, Artificial Sequence
  Description of Artificial Sequence: Synthetic polypeptide
MYPYDVPDYAGYPYDVPDYAGSYPYDVPDYAGSGSGSAAAKAEMQLMSPLQISDPFGSFPHSPTMDNYPKLEEMMLLSNGAPQFLGAAGAPEGSGSNSSSSSSGGGGGGGGGSNSSSSSSTFNPQADTGEQPYEHLTAESFPDISLNNEKVLVETSYPSQTTRLPPITYTGRFSLEPAPNSGNTLWPEPLFSLVSGLVSMTNPPASSSSAPSPAASSASASQSPPLSCAVPSNDSSPIYSAAPTFPTPNTDIFPEPQSQAFPGSAGTALQYPPPAYPAAKGGFQVPMIPDYLFPQQQGDLGLGTPDQKPFQGLESRTQQPSLTPLSTIKAFATQSGSQDLKALNTSYQSQLIKPSRMRKYPNRPSKTPPHERPYACPVESCDRRFSRSDNLVRHIRIHTGQKPFQCRICMRNFSREDNLHTHIRTHTGEKPFACDICGRKFARSDELVRHTKIHLRQKDRPYACPVESCDRRFSQSGNLTEHIRIHTGQKPFQCRICMRNFSTSGHLVRHIRTHTGEKPFACDICGRKFAQNSTLTEHTKIHLRQKDKKADKSVVASSATSSLSSYPSPVATSYPSPVTTSYPSPATTSYPSPVPTSFSSPGSSTYPSPVHSGFPSPSVATTYSSVPPAFPAQVSSFPSSAVTNSFSASTGLSDMTATFSPRTIEIC

SEQ ID NO: 296 - protein, 719 aa, Artificial Sequence
  Description of Artificial Sequence: Synthetic polypeptide
MAAAKAEMQLMSPLQISDPFGSFPHSPTMDNYPKLEEMMLLSNGAPQFLGAAGAPEGSGSNSSSSSSGGGGGGGGGSNSSSSSSTFNPQADTGEQPYEHLTAESFPDISLNNEKVLVETSYPSQTTRLPPITYTGRFSLEPAPNSGNTLWPEPLFSLVSGLVSMTNPPASSSSAPSPAASSASASQSPPLSCAVPSNDSSPIYSAAPTFPTPNTDIFPEPQSQAFPGSAGTALQYPPPAYPAAKGGFQVPMIPDYLFPQQQGDLGLGTPDQKPFQGLESRTQQPSLTPLSTIKAFATQSGSQDLKALNTSYQSQLIKPSRMRKYPNRPSKTPPHERPYACPVESCDRRFSDPGALVRHIRIHTGQKPFQCRICMRNFSRSDNLVRHIRTHTGEKPFACDICGRKFAQSGDLRRHTKIHLRQKDRPYACPVESCDRRFSTHLDLIRHIRIHTGQKPFQCRICMRNFSTSGNLVRHIRTHTGEKPFACDICGRKFARSDNLVRHTKIHLRQKDRPYACPVESCDRRFSQSGHLTEHIRIHTGQKPFQCRICMRNFSERSHLREHIRTHTGEKPFACDICGRKFAQAGHLASHTKIHLRQKDKKADKSVVASSATSSLSSYPSPVATSYPSPVTTSYPSPATTSYPSPVPTSFSSPGSSTYPSPVHSGFPSPSVATTYSSVPPAFPAQVSSFPSSAVTNSFSASTGLSDMTATFSPRTIEIC

SEQ ID NO: 297 - protein, 197 aa, Artificial Sequence
  Description of Artificial Sequence: Synthetic polypeptide
MRKYPNRPSKTPPHERPYACPVESCDRRFSRSDNLTRHIRIHTGQKPFQCRICMRNFSHSTTLTNHIRTHTGEKPFACDICGRKFARSDNRKTHIRTHTGEKPFACDICGRKFSTSHSLTEHIRIHTGQKPFQCRICMRNFSQSSSLTRHIRTHTGEKPFACDICGRKFARSDNRKTHTKIHLRQKDKKADKSVVAS

SEQ ID NO: 298 - protein, 197 aa, Artificial Sequence
  Description of Artificial Sequence: Synthetic polypeptide
MRKYPNRPSKTPPHERPYACPVESCDRRFSRSDNLTRHIRIHTGQKPFQCRICMRNFSRSDNLTTHIRTHTGEKPFACDICGRKFARSDERKRHIRTHTGEKPFACDICGRKFSQSGNLTEHIRIHTGQKPFQCRICMRNFSTSGHLTRHIRTHTGEKPFACDICGRKFAQSSTRKEHTKIHLRQKDKKADKSVVAS

SEQ ID NO: 299 - protein, 627 aa, Artificial Sequence
  Description of Artificial Sequence: Synthetic polypeptide
MAAAKAEMQLMSPLQISDPFGSFPHSPTMDNYPKLEEMMLLSNGAPQFLGAAGAPEGSGSNSSSSSSGGGGGGGGGSNSSSSSSTFNPQADTGEQPYEHLTAESFPDISLNNEKVLVETSYPSQTTRLPPITYTGRFSLEPAPNSGNTLWPEPLFSLVSGLVSMTNPPASSSSAPSPAASSASASQSPPLSCAVPSNDSSPIYSAAPTFPTPNTDIFPEPQSQAFPGSAGTALQYPPPAYPAAKGGFQVPMIPDYLFPQQQGDLGLGTPDQKPFQGLESRTQQPSLTPLSTIKAFATQSGSQDLKALNTSYQSQLIKPSRMRKYPNRPSKTPPHERPYACPVESCDRRFSRSDNLVRHIRIHTGQKPFQCRICMRNFSREDNLHTHIRTHTGEKPFACDICGRKFARSDELVRHIRTHTGEKPFACDICGRKFSQSGNLTEHIRIHTGQKPFQCRICMRNFSTSGHLVRHIRTHTGEKPFACDICGRKFAQNSTLTEHTKIHLRQKDKKADKSVVASSATSSLSSYPSPVATSYPSPVTTSYPSPATTSYPSPVPTSFSSPGSSTYPSPVHSGFPSPSVATTYSSVPPAFPAQVSSFPSSAVTNSFSASTGLSDMTATFSPRTIEIC

SEQ ID NO: 300-304 - skipped (5 entries)

SEQ ID NO: 305 - protein, 753 aa, Artificial Sequence
  Description of Artificial Sequence: Synthetic polypeptide
MAPKKKRKVGIHGVPAALEPGEKPYKCPECGKSFSRSDNLVRHQRTHTGEKPYKCPECGKSFSREDNLHTHQRTHTGEKPYKCPECGKSFSRSDELVRHQRTHTGEKPYKCPECGKSFSQSGNLTEHQRTHTGEKPYKCPECGKSFSTSGHLVRHQRTHTGEKPYKCPECGKSFSQNSTLTEHQRTHTGKKTSKRPAATKKAGQAKKKKGSYPYDVPDYALEEASGSGRADALDDFDLDMLGSDALDDFDLDMLGSDALDDFDLDMLGSDALDDFDLDMLINSRSSGSPKKKRKVGSQYLPDTDDRHRIEEKRKRTYETFKSIMKKSPFSGPTDPRPPPRRIAVPSRSSASVPKPAPQPYPFTSSLSTINYDEFPTMVFPSGQISQASALAPAPPQVLPQAPAPAPAPAMVSALAQAPAPVPVLAPGPPQAVAPPAPKPTQAGEGTLSEALLQLQFDDEDLGALLGNSTDPAVFTDLASVDNSEFQQLLNQGIPVAPHTTEPMLMEYPEAITRLVTGAQRPPDPAPAPLGAPGLPNGLLSGDEDFSSIADMDFSALLGSGSGSRDSREGMFLPKPEAGSAISDVFEGREVCQPKRIRPFHPPGSPWANRPLPASLAPTPTGPVHEPVGSLTPAPVPQPLDPAPAVTPEASHLLEDPDEETSQAVKALREMADTVIPQKEEAAICGQMDLSHPPPRGHLDELTTTLESMTEDLNLDSPLTPELNEILDTFLNDECLLHAMHISTGLSIFDTSLF

SEQ ID NO: 306 - protein, 272 aa, Artificial Sequence; identical to SEQ ID NO: 271
  Description of Artificial Sequence: Synthetic polypeptide

SEQ ID NO: 307 - protein, 272 aa, Artificial Sequence; identical to SEQ ID NO: 271
  Description of Artificial Sequence: Synthetic polypeptide

SEQ ID NO: 308 - protein, 272 aa, Artificial Sequence; identical to SEQ ID NO: 271
  Description of Artificial Sequence: Synthetic polypeptide

SEQ ID NO: 309 - protein, 753 aa, Artificial Sequence
  Description of Artificial Sequence: Synthetic polypeptide
MAPKKKRKVGIHGVPAALEPGEKPYKCPECGKSFSRSDNLVRHQRTHTGEKPYKCPECGKSFSHRTTLTNHQRTHTGEKPYKCPECGKSFSREDNLHTHQRTHTGEKPYKCPECGKSFSTSHSLTEHQRTHTGEKPYKCPECGKSFSQSSSLVRHQRTHTGEKPYKCPECGKSFSREDNLHTHQRTHTGKKTSKRPAATKKAGQAKKKKGSYPYDVPDYALEEASGSGRADALDDFDLDMLGSDALDDFDLDMLGSDALDDFDLDMLGSDALDDFDLDMLINSRSSGSPKKKRKVGSQYLPDTDDRHRIEEKRKRTYETFKSIMKKSPFSGPTDPRPPPRRIAVPSRSSASVPKPAPQPYPFTSSLSTINYDEFPTMVFPSGQISQASALAPAPPQVLPQAPAPAPAPAMVSALAQAPAPVPVLAPGPPQAVAPPAPKPTQAGEGTLSEALLQLQFDDEDLGALLGNSTDPAVFTDLASVDNSEFQQLLNQGIPVAPHTTEPMLMEYPEAITRLVTGAQRPPDPAPAPLGAPGLPNGLLSGDEDFSSIADMDFSALLGSGSGSRDSREGMFLPKPEAGSAISDVFEGREVCQPKRIRPFHPPGSPWANRPLPASLAPTPTGPVHEPVGSLTPAPVPQPLDPAPAVTPEASHLLEDPDEETSQAVKALREMADTVIPQKEEAAICGQMDLSHPPPRGHLDELTTTLESMTEDLNLDSPLTPELNEILDTFLNDECLLHAMHISTGLSIFDTSLF

SEQ ID NO: 310 - protein, 272 aa, Artificial Sequence; identical to SEQ ID NO: 279
  Description of Artificial Sequence: Synthetic polypeptide

SEQ ID NO: 311 - protein, 837 aa, Artificial Sequence
  Description of Artificial Sequence: Synthetic polypeptide
MAPKKKRKVGIHGVPAALEPGEKPYKCPECGKSFSRRDELNVHQRTHTGEKPYKCPECGKSFSRSDHLTNHQRTHTGEKPYKCPECGKSFSRSDDLVRHQRTHTGEKPYKCPECGKSFSRSDNLVRHQRTHTGEKPYKCPECGKSFSHRTTLTNHQRTHTGEKPYKCPECGKSFSREDNLHTHQRTHTGEKPYKCPECGKSFSTSHSLTEHQRTHTGEKPYKCPECGKSFSQSSSLVRHQRTHTGEKPYKCPECGKSFSREDNLHTHQRTHTGKKTSKRPAATKKAGQAKKKKGSYPYDVPDYALEEASGSGRADALDDFDLDMLGSDALDDFDLDMLGSDALDDFDLDMLGSDALDDFDLDMLINSRSSGSPKKKRKVGSQYLPDTDDRHRIEEKRKRTYETFKSIMKKSPFSGPTDPRPPPRRIAVPSRSSASVPKPAPQPYPFTSSLSTINYDEFPTMVFPSGQISQASALAPAPPQVLPQAPAPAPAPAMVSALAQAPAPVPVLAPGPPQAVAPPAPKPTQAGEGTLSEALLQLQFDDEDLGALLGNSTDPAVFTDLASVDNSEFQQLLNQGIPVAPHTTEPMLMEYPEAITRLVTGAQRPPDPAPAPLGAPGLPNGLLSGDEDFSSIADMDFSALLGSGSGSRDSREGMFLPKPEAGSAISDVFEGREVCQPKRIRPFHPPGSPWANRPLPASLAPTPTGPVHEPVGSLTPAPVPQPLDPAPAVTPEASHLLEDPDEETSQAVKALREMADTVIPQKEEAAICGQMDLSHPPPRGHLDELTTTLESMTEDLNLDSPLTPELNEILDTFLNDECLLHAMHISTGLSIFDTSLF

SEQ ID NO: 312 - protein, 356 aa, Artificial Sequence
  Description of Artificial Sequence: Synthetic polypeptide
MAPKKKRKVGIHGVPAALEPGEKPYKCPECGKSFSRRDELNVHQRTHTGEKPYKCPECGKSFSRSDHLTNHQRTHTGEKPYKCPECGKSFSRSDDLVRHQRTHTGEKPYKCPECGKSFSRSDNLVRHQRTHTGEKPYKCPECGKSFSHRTTLTNHQRTHTGEKPYKCPECGKSFSREDNLHTHQRTHTGEKPYKCPECGKSFSTSHSLTEHQRTHTGEKPYKCPECGKSFSQSSSLVRHQRTHTGEKPYKCPECGKSFSREDNLHTHQRTHTGKKTSKRPAATKKAGQAKKKKGSYPYDVPDYALEDALDDFDLDMLGSDALDDFDLDMLGSDALDDFDLDMLGSDALDDFDLDML

SEQ ID NO: 313 - protein, 631 aa, Artificial Sequence; identical to SEQ ID NO: 6
  Description of Artificial Sequence: Synthetic polypeptide

SEQ ID NO: 314 - protein, 631 aa, Artificial Sequence; identical to SEQ ID NO: 6
  Description of Artificial Sequence: Synthetic polypeptide

SEQ ID NO: 315 - protein, 394 aa, Artificial Sequence; identical to SEQ ID NO: 69
  Description of Artificial Sequence: Synthetic polypeptide

SEQ ID NO: 316 - protein, 580 aa, Artificial Sequence; identical to SEQ ID NO: 62
  Description of Artificial Sequence: Synthetic polypeptide

SEQ ID NO: 317 - protein, 627 aa, Artificial Sequence; identical to SEQ ID NO: 8
  Description of Artificial Sequence: Synthetic polypeptide

SEQ ID NO: 318 - protein, 394 aa, Artificial Sequence; identical to SEQ ID NO: 68
  Description of Artificial Sequence: Synthetic polypeptide

SEQ ID NO: 319 - protein, 580 aa, Artificial Sequence; identical to SEQ ID NO: 67
  Description of Artificial Sequence: Synthetic polypeptide

SEQ ID NO: 320 - protein, 719 aa, Artificial Sequence; identical to SEQ ID NO: 9
  Description of Artificial Sequence: Synthetic polypeptide

SEQ ID NO: 321 - protein, 719 aa, Artificial Sequence; identical to SEQ ID NO: 9
  Description of Artificial Sequence: Synthetic polypeptide

SEQ ID NO: 322 - protein, 719 aa, Artificial Sequence; identical to SEQ ID NO: 9
  Description of Artificial Sequence: Synthetic polypeptide

SEQ ID NO: 323 - protein, 473 aa, Artificial Sequence; identical to SEQ ID NO: 13
  Description of Artificial Sequence: Synthetic polypeptide

SEQ ID NO: 324 - protein, 386 aa, Artificial Sequence
  Description of Artificial Sequence: Synthetic polypeptide
MAADHLMLAEGYRLVQRPPSAAAAHGPHALRTLPPYAGPGLDSGLRPRGAPLGPPPPRQPGALAYGAFGPPSSFQPFPAVPPPAAGIAHLQPVATPYPGRAAAPPNAPGGPPGPQPAPSAAAPPPPAHALGGMDAELIDEEALTSLELELGLHRVRELPELFLGQSEFDCFSDLGSAPPAGSVSCQSQLIKPSRMRKYPNRPSKTPPHERPYACPVESCDRRFSRSDNLVRHIRIHTGQKPFQCRICMRNFSHRTTLTNHIRTHTGEKPFACDICGRKFAREDNLHTHTKIHLRQKDRPYACPVESCDRRFSTSHSLTEHIRIHTGQKPFQCRICMRNFSQSSSLVRHIRTHTGEKPFACDICGRKFAREDNLHTHTKIHLRQKDK

SEQ ID NO: 325 - protein, 627 aa, Artificial Sequence; identical to SEQ ID NO: 8
  Description of Artificial Sequence: Synthetic polypeptide

SEQ ID NO: 326 - DNA, 62 bp, Artificial Sequence
  Description of Artificial Sequence: Synthetic oligonucleotide
aataaaagatctttattttcattagatctgtgtgttggttttttgtgtgcggaccgcacgtg

SEQ ID NO: 327 - DNA, 477 bp, Artificial Sequence
  Description of Artificial Sequence: Synthetic polynucleotide
gggtggcatccctgtgacccctccccagtgcctctcctggccctggaagttgccactccagtgcccaccagccttgtcctaataaaattaagttgcatcattttgtctgactaggtgtccttctataatattatggggtggaggggggtggtatggagcaaggggcaagttgggaagacaacctgtagggcctgcggggtctattgggaaccaagctggagtgcagtggcacaatcttggctcactgcaatctccgcctcctgggttcaagcgattctcctgcctcagcctcccgagttgttgggattccaggcatgcatgaccaggctcagctaatttttgtttttttggtagagacggggtttcaccatattggccaggctggtctccaactcctaatctcaggtgatctacccaccttggcctcccaaattgctgggattacaggcgtgaaccactgctcccttccctgtcctt

SEQ ID NO: 328 - DNA, 23 bp, Artificial Sequence
  Description of Artificial Sequence: Synthetic primer
ccatggaactggctcgatttcac

SEQ ID NO: 329 - DNA, 27 bp, Artificial Sequence
  Description of Artificial Sequence: Synthetic probe
aggcctgaaaaccattgtgggagccct

SEQ ID NO: 330 - DNA, 18 bp, Homo sapiens
cgcactgtcaatgcccca

SEQ ID NO: 331 - DNA, 18 bp, Homo sapiens
cctgctgaggctgtcccg

SEQ ID NO: 332 - DNA, 18 bp, Homo sapiens
aatggggtgtggggcgag

SEQ ID NO: 333 - DNA, 18 bp, Homo sapiens
cctagaaatggggtgtgg

SEQ ID NO: 334 - DNA, 27 bp, Homo sapiens
tgagtagaaaagaaacacagcattcca

SEQ ID NO: 335 - DNA, 21 bp, Homo sapiens
gagtagaaaagaaacacagca

SEQ ID NO: 336 - DNA, 21 bp, Homo sapiens
agtagaaaagaaacacagcat

SEQ ID NO: 337 - protein, 272 aa, Artificial Sequence
  Description of Artificial Sequence: Synthetic polypeptide
MAPKKKRKVGIHGVPAALEPGEKPYKCPECGKSFSTSHSLTEHQRTHTGEKPYKCPECGKSFSDCRDLARHQRTHTGEKPYKCPECGKSFSTTGNLTVHQRTHTGEKPYKCPECGKSFSDPGALVRHQRTHTGEKPYKCPECGKSFSTHLDLIRHQRTHTGEKPYKCPECGKSFSHTGHLLEHQRTHTGKKTSKRPAATKKAGQAKKKKGSYPYDVPDYALEDALDDFDLDMLGSDALDDFDLDMLGSDALDDFDLDMLGSDALDDFDLDML

SEQ ID NO: 338 - protein, 272 aa, Artificial Sequence
  Description of Artificial Sequence: Synthetic polypeptide
MAPKKKRKVGIHGVPAALEPGEKPYKCPECGKSFSRNDTLTEHQRTHTGEKPYKCPECGKSFSDPGALVRHQRTHTGEKPYKCPECGKSFSTSGELVRHQRTHTGEKPYKCPECGKSFSRSDNLVRHQRTHTGEKPYKCPECGKSFSTSGELVRHQRTHTGEKPYKCPECGKSFSTKNSLTEHQRTHTGKKTSKRPAATKKAGQAKKKKGSYPYDVPDYALEDALDDFDLDMLGSDALDDFDLDMLGSDALDDFDLDMLGSDALDDFDLDML

SEQ ID NO: 339 - protein, 781 aa, Artificial Sequence
  Description of Artificial Sequence: Synthetic polypeptide
MAPKKKRKVGIHGVPAALEPGEKPYKCPECGKSFSTSGNLTEHQRTHTGEKPYKCPECGKSFSRADNLTEHQRTHTGEKPYKCPECGKSFSSPADLTRHQRTHTGEKPYKCPECGKSFSQSSNLVRHQRTHTGEKPYKCPECGKSFSQRANLRAHQRTHTGEKPYKCPECGKSFSQLAHLRAHQRTHTGEKPYKCPECGKSFSHRTTLTNHQRTHTGKKTSKRPAATKKAGQAKKKKGSYPYDVPDYALEEASGSGRADALDDFDLDMLGSDALDDFDLDMLGSDALDDFDLDMLGSDALDDFDLDMLINSRSSGSPKKKRKVGSQYLPDTDDRHRIEEKRKRTYETFKSIMKKSPFSGPTDPRPPPRRIAVPSRSSASVPKPAPQPYPFTSSLSTINYDEFPTMVFPSGQISQASALAPAPPQVLPQAPAPAPAPAMVSALAQAPAPVPVLAPGPPQAVAPPAPKPTQAGEGTLSEALLQLQFDDEDLGALLGNSTDPAVFTDLASVDNSEFQQLLNQGIPVAPHTTEPMLMEYPEAITRLVTGAQRPPDPAPAPLGAPGLPNGLLSGDEDFSSIADMDFSALLGSGSGSRDSREGMFLPKPEAGSAISDVFEGREVCQPKRIRPFHPPGSPWANRPLPASLAPTPTGPVHEPVGSLTPAPVPQPLDPAPAVTPEASHLLEDPDEETSQAVKALREMADTVIPQKEEAAICGQMDLSHPPPRGHLDELTTTLESMTEDLNLDSPLTPELNEILDTFLNDECLLHAMHISTGLSIFDTSLF

SEQ ID NO: 340 - protein, 272 aa, Artificial Sequence
  Description of Artificial Sequence: Synthetic polypeptide
MAPKKKRKVGIHGVPAALEPGEKPYKCPECGKSFSSPADLTRHQRTHTGEKPYKCPECGKSFSDSGNLRVHQRTHTGEKPYKCPECGKSFSQLAHLRAHQRTHTGEKPYKCPECGKSFSQRANLRAHQRTHTGEKPYKCPECGKSFSREDNLHTHQRTHTGEKPYKCPECGKSFSRSDNLVRHQRTHTGKKTSKRPAATKKAGQAKKKKGSYPYDVPDYALEDALDDFDLDMLGSDALDDFDLDMLGSDALDDFDLDMLGSDALDDFDLDML

SEQ ID NO: 341 - protein, 753 aa, Artificial Sequence
  Description of Artificial Sequence: Synthetic polypeptide
MAPKKKRKVGIHGVPAALEPGEKPYKCPECGKSFSSPADLTRHQRTHTGEKPYKCPECGKSFSDSGNLRVHQRTHTGEKPYKCPECGKSFSQLAHLRAHQRTHTGEKPYKCPECGKSFSQRANLRAHQRTHTGEKPYKCPECGKSFSREDNLHTHQRTHTGEKPYKCPECGKSFSRSDNLVRHQRTHTGKKTSKRPAATKKAGQAKKKKGSYPYDVPDYALEEASGSGRADALDDFDLDMLGSDALDDFDLDMLGSDALDDFDLDMLGSDALDDFDLDMLINSRSSGSPKKKRKVGSQYLPDTDDRHRIEEKRKRTYETFKSIMKKSPFSGPTDPRPPPRRIAVPSRSSASVPKPAPQPYPFTSSLSTINYDEFPTMVFPSGQISQASALAPAPPQVLPQAPAPAPAPAMVSALAQAPAPVPVLAPGPPQAVAPPAPKPTQAGEGTLSEALLQLQFDDEDLGALLGNSTDPAVFTDLASVDNSEFQQLLNQGIPVAPHTTEPMLMEYPEAITRLVTGAQRPPDPAPAPLGAPGLPNGLLSGDEDFSSIADMDFSALLGSGSGSRDSREGMFLPKPEAGSAISDVFEGREVCQPKRIRPFHPPGSPWANRPLPASLAPTPTGPVHEPVGSLTPAPVPQPLDPAPAVTPEASHLLEDPDEETSQAVKALREMADTVIPQKEEAAICGQMDLSHPPPRGHLDELTTTLESMTEDLNLDSPLTPELNEILDTFLNDECLLHAMHISTGLSIFDTSLF

SEQ ID NO: 342 - protein, 753 aa, Artificial Sequence; identical to SEQ ID NO: 341
  Description of Artificial Sequence: Synthetic polypeptide

SEQ ID NO: 343 - protein, 272 aa, Artificial Sequence; identical to SEQ ID NO: 340
  Description of Artificial Sequence: Synthetic polypeptide

SEQ ID NO: 344 - protein, 837 aa, Artificial Sequence
  Description of Artificial Sequence: Synthetic polypeptide
MAPKKKRKVGIHGVPAALEPGEKPYKCPECGKSFSTSHSLTEHQRTHTGEKPYKCPECGKSFSHKNALQNHQRTHTGEKPYKCPECGKSFSERSHLREHQRTHTGEKPYKCPECGKSFSSKKALTEHQRTHTGEKPYKCPECGKSFSQRANLRAHQRTHTGEKPYKCPECGKSFSRKDNLKNHQRTHTGEKPYKCPECGKSFSQSSNLVRHQRTHTGEKPYKCPECGKSFSQSSSLVRHQRTHTGEKPYKCPECGKSFSQAGHLASHQRTHTGKKTSKRPAATKKAGQAKKKKGSYPYDVPDYALEEASGSGRADALDDFDLDMLGSDALDDFDLDMLGSDALDDFDLDMLGSDALDDFDLDMLINSRSSGSPKKKRKVGSQYLPDTDDRHRIEEKRKRTYETFKSIMKKSPFSGPTDPRPPPRRIAVPSRSSASVPKPAPQPYPFTSSLSTINYDEFPTMVFPSGQISQASALAPAPPQVLPQAPAPAPAPAMVSALAQAPAPVPVLAPGPPQAVAPPAPKPTQAGEGTLSEALLQLQFDDEDLGALLGNSTDPAVFTDLASVDNSEFQQLLNQGIPVAPHTTEPMLMEYPEAITRLVTGAQRPPDPAPAPLGAPGLPNGLLSGDEDFSSIADMDFSALLGSGSGSRDSREGMFLPKPEAGSAISDVFEGREVCQPKRIRPFHPPGSPWANRPLPASLAPTPTGPVHEPVGSLTPAPVPQPLDPAPAVTPEASHLLEDPDEETSQAVKALREMADTVIPQKEEAAICGQMDLSHPPPRGHLDELTTTLESMTEDLNLDSPLTPELNEILDTFLNDECLLHAMHISTGLSIFDTSLF

SEQ ID NO: 345 - protein, 479 aa, Artificial Sequence
  Description of Artificial Sequence: Synthetic polypeptide
MQSQLIKPSRMRKYPNRPSKTPPHERPYACPVESCDRRFSSPADLTRHIRIHTGQKPFQCRICMRNFSDSGNLRVHIRTHTGEKPFACDICGRKFAQLAHLRAHTKIHLRQKDRPYACPVESCDRRFSQRANLRAHIRIHTGQKPFQCRICMRNFSREDNLHTHIRTHTGEKPFACDICGRKFARSDNLVRHTKIHLRQKDKLEMSGLEMADHMMAMNHGRFPDGTNGLHHHPAHRMGMGQFPSPHHHQQQQPQHAFNALMGEHIHYGAGNMNATSGIRHAMGPGTVNGGHPPSALAPAARFNNSQFMGPPVASQGGSLPASMQLQKLNNQYFNHHPYPHNHYMPDLHPAAGHQMNGTNQHFRDCNPKHSGGSSTPGGSGGSSTPGGSGSSSGGGAGSSNSGGGSGSGNMPASVAHVPAAMLPPNVIDTDFIDEEVLMSLVIEMGLDRIKELPELWLGQNEFDFMTDFVCKQQPSRVSC

SEQ ID NO: 346 - protein, 476 aa, Artificial Sequence
  Description of Artificial Sequence: Synthetic polypeptide
MSGLEMADHMMAMNHGRFPDGTNGLHHHPAHRMGMGQFPSPHHHQQQQPQHAFNALMGEHIHYGAGNMNATSGVRHAMGPGTVNGGHPPSALAPAARFNNSQFMGPPVASQGGSLPASMQLQKLNNQYFNHHPYPHNHYMPDLHPAAGHQMNGTNQHFRDCNPKHSGGSSTPGGSGGSSTPGGSGSSSGGGAGSSNSGGGSGSGNMPASVAHVPAAMLPPNVIDTDFIDEEVLMSLVIEMGLDRIKELPELWLGQNEFDFMTDFVCKQQPSRVSCQSQLIKPSRMRKYPNRPSKTPPHERPYACPVESCDRRFSSPADLTRHIRIHTGQKPFQCRICMRNFSDSGNLRVHIRTHTGEKPFACDICGRKFAQLAHLRAHTKIHLRQKDRPYACPVESCDRRFSQRANLRAHIRIHTGQKPFQCRICMRNFSREDNLHTHIRTHTGEKPFACDICGRKFARSDNLVRHTKIHLRQKDK

SEQ ID NO: 347 - protein, 479 aa, Artificial Sequence
  Description of Artificial Sequence: Synthetic polypeptide
MRPHACPAEGCDRRFSSPADLTRHLRIHTGHKPFQCRICMRSFSDSGNLRVHIRTHTGEKPFACEFCGRKFAQLAHLRAHAKIHLKQKEHACPAEGCDRRFSQRANLRAHLRIHTGHKPFQCRICMRSFSREDNLHTHIRTHTGEKPFACEFCGRKFARSDNLVRHAKIHLKQKEKKAEKGGAPSASSAPPVSLAPVVTTCALEMSGLEMADHMMAMNHGRFPDGTNGLHHHPAHRMGMGQFPSPHHHQQQQPQHAFNALMGEHIHYGAGNMNATSGIRHAMGPGTVNGGHPPSALAPAARFNNSQFMGPPVASQGGSLPASMQLQKLNNQYFNHHPYPHNHYMPDLHPAAGHQMNGTNQHFRDCNPKHSGGSSTPGGSGGSSTPGGSGSSSGGGAGSSNSGGGSGSGNMPASVAHVPAAMLPPNVIDTDFIDEEVLMSLVIEMGLDRIKELPELWLGQNEFDFMTDFVCKQQPSRVSC

SEQ ID NO: 348 - protein, 476 aa, Artificial Sequence; identical to SEQ ID NO: 73
  Description of Artificial Sequence: Synthetic polypeptide

SEQ ID NO: 349 - protein, 362 aa, Artificial Sequence; identical to SEQ ID NO: 76
  Description of Artificial Sequence: Synthetic polypeptide

SEQ ID NO: 350 - protein, 554 aa, Artificial Sequence; identical to SEQ ID NO: 77
  Description of Artificial Sequence: Synthetic polypeptide

SEQ ID NO: 351 - protein, 194 aa, Artificial Sequence
  Description of Artificial Sequence: Synthetic polypeptide
RKYPNRPSKTPPHERPYACPVESCDRRFSRSDNLVRHIRIHTGQKPFQCRICMRNFSHRTTLTNHIRTHTGEKPFACDICGRKFAREDNLHTHIRTHTGEKPFACDICGRKFSTSHSLTEHIRIHTGQKPFQCRICMRNFSQSSSLVRHIRTHTGEKPFACDICGRKFAREDNLHTHTKIHLRQKDKKADKSVV

SEQ ID NO: 352 - skipped

SEQ ID NO: 353 - DNA, 4380 bp, Artificial Sequence
  Description of Artificial Sequence: Synthetic polynucleotide
ggaggaagccatcaactaaactacaatgactgtaagatacaaaattgggaatggtaacatattttgaagttctgttgacataaagaatcatgatattaatgcccatggaaatgaaagggcgatcaacactatggtttgaaaagggggaaattgtagagcacagatgtgttcgtgtggcagtgtgctgtctctagcaatactcagagaagagagagaacaatgaaattctgattggccccagtgtgagcccagatgaggttcagctgccaactttctctttcacatcttatgaaagtcatttaagcacaactaactttttttttttttttttttttttgagacagagtcttgctctgttgcccaggacagagtgcagtagtgactcaatctcggctcactgcagcctccacctcctaggctcaaacggtcctcctgcatcagcctcccaagtagctggaattacaggagtggcccaccatgcccagctaatttttgtatttttaatagatacgggggtttcaccatatcacccaggctggtctcgaactcctggcctcaagtgatccacctgcctcggcctcccaaagtgctgggattataggcgtcagccactatgcccaacccgaccaaccttttttaaaataaatatttaaaaaattggtatttcacatatatactagtatttacatttatccacacaaaacggacgggcctccgctgaaccagtgaggccccagacgtgcgcataaataacccctgcgtgctgcaccacctggggagagggggaggaccacggtaaatggagcgagcgcatagcaaaagggacgcggggtccttttctctgccggtggcactgggtagctgtggccaggtgtggtactttgatggggcccagggctggagctcaaggaagcgtcgcagggtcacagatctgggggaaccccggggaaaagcactgaggcaaaaccgccgctcgtctcctacaatatatgggagggggaggttgagtacgttctggattactcataagaccttttttttttccttccgggcgcaaaaccgtgagctggatttataatcgccctataaagctccagaggcggtcaggcacctgcagaggagccccgccgctccgccgactagctgcccccgcgagcaacggcctcgtgatttccccgccgatccggtccccgcctccccactctgcccccgcctaccccggagccgtgcagccgcctctccgaatctctctcttctcctggcgctcgcgtgcgagagggaactagcgagaacgaggaagcagctggaggtgacgccgggcagattacgcctgtcagggccgagccgagcggatcgctgggcgctgtgcagaggaaaggcgggagtgcccggctcgctgtcgcagagccgaggtgggtaagctagcgaccacctggacttcccagcgcccaaccgtggcttttcagccaggtcctctcctcccgcggcttctcaaccaaccccatcccagcgccggccacccaacctcccgaaatgagtgcttcctgccccagcagccgaaggcgctactaggaacggtaacctgttacttttccaggggccgtagtcgacccgctgcccgagttgctgtgcgactgcgcgcgcggggctagagtgcaaggtgactgtggttcttctctggccaagtccgagggagaacgtaaagatatgggcctttttccccctctcaccttgtctcaccaaagtccctagtccccggagcagttagcctctttctttccagggaattagccagacacaacaacgggaaccagacaccgaaccagacatgcccgccccgtgcgccctccccgctcgctgcctttcctccctcttgtctctccagagccggatcttcaaggggagcctccgtgcccccggctgctcagtccctccggtgtgcaggaccccggaagtcctccccgcacagctctcgcttctctttgcagcctgtttctgcgccggaccagtcgaggactctggacagtagaggccccgggacgaccgagctggaattcgccaccatggccccaaagaagaagcggaaggtcggtatccacggagtcccagcagccctcgaaccaggtgaaaaaccttacaaatgtcctgaatgtgggaaatcattcagtcgcagcgacaacctggtgagacatcaacgcacccatacaggagaaaaaccttataaatgtccagaatgtggaaagtccttctcacgagaggataacttgcacactcatcaacgaacacatactggtgaaaaaccatacaagtgtcccgaatgtggtaaaagttttagccggagcgatgaacttgtccgacaccaacgaacccatacaggcgagaagccttacaaatgtcccgagtgtggcaagagcttctcacaatcagggaatctgactgagcatcaacgaactcataccggggaaaaaccttacaagtgtccagagtgtgggaagagcttttccacaagtggacatctggtacgccaccagaggacacatacaggggagaagccctacaaatgccccgaatgcggtaaaagtttctctcagaatagtaccctgaccgaacaccagcgaacacacactgggaaaaaaacgagtaaaaggccggcggccacgaaaaaggccggccaggcaaaaaagaaaaagggatcctacccatacgacgtaccagattacgctctcgaggaggccagcggttccggacgggctgacgcattggacgattttgatctggatatgctgggaagtgacgccctcgatgattttgaccttgacatgcttggttcggatgcccttgatgactttgacctcgacatgctcggcagtgacgcccttgatgatttcgacctggacatgctgattaactctagaagttccggatctccgaaaaagaaacgcaaagttggtagccagtacctgcccgacaccgacgaccggcaccggatcgaggaaaagcggaagcggacctacgagacattcaagagcatcatgaagaagtcccccttcagcggccccaccgaccctagacctccacctagaagaatcgccgtgcccagcagatccagcgccagcgtgccaaaacctgccccccagccttaccccttcaccagcagcctgagcaccatcaactacgacgagttccctaccatggtgttccccagcggccagatctctcaggcctctgctctggctccagcccctcctcaggtgctgcctcaggctcctgctcctgcaccagctccagccatggtgtctgcactggctcaggcaccagcacccgtgcctgtgctggctcctggacctccacaggctgtggctccaccagcccctaaacctacacaggccggcgagggcacactgtctgaagctctgctgcagctgcagttcgacgacgaggatctgggagccctgctgggaaacagcaccgatcctgccgtgttcaccgacctggccagcgtggacaacagcgagttccagcagctgctgaaccagggcatccctgtggcccctcacaccaccgagcccatgctgatggaataccccgaggccatcacccggctcgtgacaggcgctcagaggcctcctgatccagctcctgcccctctgggagcaccaggcctgcctaatggactgctgtctggcgacgaggacttcagctctatcgccgatatggatttctcagccttgctgggctctggcagcggcagccgggattccagggaagggatgtttttgccgaagcctgaggccggctccgctattagtgacgtgtttgagggccgcgaggtgtgccagccaaaacgaatccggccatttcatcctccaggaagtccatgggccaaccgcccactccccgccagcctcgcaccaacaccaaccggtccagtacatgagccagtcgggtcactgaccccggcaccagtccctcagccactggatccagcgcccgcagtgactcccgaggccagtcacctgttggaggatcccgatgaagagacgagccaggctgtcaaagcccttcgggagatggccgatactgtgattccccagaaggaagaggctgcaatctgtggccaaatggacctttcccatccgcccccaaggggccatctggatgagctgacaaccacacttgagtccatgaccgaggatctgaacctggactcacccctgaccccggaattgaacgagattctggataccttcctgaacgacgagtgcctcttgcatgccatgcatatcagcacaggactgtccatcttcgacacatctctgttttaaactagtaataaaagatctttattttcattagatctgtgtgttggttttttgtgtg

SEQ ID NO: 354 - DNA, 3585 bp, Artificial Sequence
  Description of Artificial Sequence: Synthetic polynucleotide
ggaggaagccatcaactaaactacaatgactgtaagatacaaaattgggaatggtaacatattttgaagttctgttgacataaagaatcatgatattaatgcccatggaaatgaaagggcgatcaacactatggtttgaaaagggggaaattgtagagcacagatgtgttcgtgtggcagtgtgctgtctctagcaatactcagagaagagagagaacaatgaaattctgattggccccagtgtgagcccagatgaggttcagctgccaactttctctttcacatcttatgaaagtcatttaagcacaactaactttttttttttttttttttttttgagacagagtcttgctctgttgcccaggacagagtgcagtagtgactcaatctcggctcactgcagcctccacctcctaggctcaaacggtcctcctgcatcagcctcccaagtagctggaattacaggagtggcccaccatgcccagctaatttttgtatttttaatagatacgggggtttcaccatatcacccaggctggtctcgaactcctggcctcaagtgatccacctgcctcggcctcccaaagtgctgggattataggcgtcagccactatgcccaacccgaccaaccttttttaaaataaatatttaaaaaattggtatttcacatatatactagtatttacatttatccacacaaaacggacgggcctccgctgaaccagtgaggccccagacgtgcgcataaataacccctgcgtgctgcaccacctggggagagggggaggaccacggtaaatggagcgagcgcatagcaaaagggacgcggggtccttttctctgccggtggcactgggtagctgtggccaggtgtggtactttgatggggcccagggctggagctcaaggaagcgtcgcagggtcacagatctgggggaaccccggggaaaagcactgaggcaaaaccgccgctcgtctcctacaatatatgggagggggaggttgagtacgttctggattactcataagaccttttttttttccttccgggcgcaaaaccgtgagctggatttataatcgccctataaagctccagaggcggtcaggcacctgcagaggagccccgccgctccgccgactagctgcccccgcgagcaacggcctcgtgatttccccgccgatccggtccccgcctccccactctgcccccgcctaccccggagccgtgcagccgcctctccgaatctctctcttctcctggcgctcgcgtgcgagagggaactagcgagaacgaggaagcagctggaggtgacgccgggcagattacgcctgtcagggccgagccgagcggatcgctgggcgctgtgcagaggaaaggcgggagtgcccggctcgctgtcgcagagccgaggtgggtaagctagcgaccacctggacttcccagcgcccaaccgtggcttttcagccaggtcctctcctcccgcggcttctcaaccaaccccatcccagcgccggccacccaacctcccgaaatgagtgcttcctgccccagcagccgaaggcgctactaggaacggtaacctgttacttttccaggggccgtagtcgacccgctgcccgagttgctgtgcgactgcgcgcgcggggctagagtgcaaggtgactgtggttcttctctggccaagtccgagggagaacgtaaagatatgggcctttttccccctctcaccttgtctcaccaaagtccctagtccccggagcagttagcctctttctttccagggaattagccagacacaacaacgggaaccagacaccgaaccagacatgcccgccccgtgcgccctccccgctcgctgcctttcctccctcttgtctctccagagccggatcttcaaggggagcctccgtgcccccggctgctcagtccctccggtgtgcaggaccccggaagtcctccccgcacagctctcgcttctctttgcagcctgtttctgcgccggaccagtcgaggactctggacagtagaggccccgggacgaccgagctggaattcgccaccatggccccaaagaagaagcggaaggtcggtatccacggagtcccagcagccctcgaaccaggtgaaaaaccttacaaatgtcctgaatgtgggaaatcattcagtcgcagcgacaacctggtgagacatcaacgcacccatacaggagaaaaaccttataaatgtccagaatgtggaaagtccttctcacgagaggataacttgcacactcatcaacgaacacatactggtgaaaaaccatacaagtgtcccgaatgtggtaaaagttttagccggagcgatgaacttgtccgacaccaacgaacccatacaggcgagaagccttacaaatgtcccgagtgtggcaagagcttctcacaatcagggaatctgactgagcatcaacgaactcataccggggaaaaaccttacaagtgtccagagtgtgggaagagcttttccacaagtggacatctggtacgccaccagaggacacatacaggggagaagccctacaaatgccccgaatgcggtaaaagtttctctcagaatagtaccctgaccgaacaccagcgaacacacactgggaaaaaaacgagtaaaaggccggcggccacgaaaaaggccggccaggcaaaaaagaaaaagggatcctacccatacgacgtaccagattacgctctcgaggacgcgctggacgatttcgatctcgacatgctgggttctgatgccctcgatgactttgacctggatatgttgggaagcgacgcattggatgactttgatctggacatgctcggctccgatgctctggacgatttcgatctcgatatgttataaactagtaaagagaccggttcactgtgacagtaaaagagaccggttcactgtgagaatgaaagagaccggttcactgtgatcggaaaagagaccggttcactgtgagcggccttgaaacccagcagacaatgtagctcagtagaaacccagcagacaatgtagctgaatggaaacccagcagacaatgtagcttcggagaaacccagcagacaatgtagctaagcttgggtggcatccctgtgacccctccccagtgcctctcctggccctggaagttgccactccagtgcccaccagccttgtcctaataaaattaagttgcatcattttgtctgactaggtgtccttctataatattatggggtggaggggggtggtatggagcaaggggcaagttgggaagacaacctgtagggcctgcggggtctattgggaaccaagctggagtgcagtggcacaatcttggctcactgcaatctccgcctcctgggttcaagcgattctcctgcctcagcctcccgagttgttgggattccaggcatgcatgaccaggctcagctaatttttgtttttttggtagagacggggtttcaccatattggccaggctggtctccaactcctaatctcaggtgatctacccaccttggcctcccaaattgctgggattacaggcgtgaaccactgctcccttccctgtcctt

SEQ ID NO: 355 - DNA, 3371 bp, Artificial Sequence
  Description of Artificial Sequence: Synthetic polynucleotide
ggaggaagccatcaactaaactacaatgactgtaagatacaaaattgggaatggtaacatattttgaagttctgttgacataaagaatcatgatattaatgcccatggaaatgaaagggcgatcaacactatggtttgaaaagggggaaattgtagagcacagatgtgttcgtgtggcagtgtgctgtctctagcaatactcagagaagagagagaacaatgaaattctgattggccccagtgtgagcccagatgaggttcagctgccaactttctctttcacatcttatgaaagtcatttaagcacaactaactttttttttttttttttttttttgagacagagtcttgctctgttgcccaggacagagtgcagtagtgactcaatctcggctcactgcagcctccacctcctaggctcaaacggtcctcctgcatcagcctcccaagtagctggaattacaggagtggcccaccatgcccagctaatttttgtatttttaatagatacgggggtttcaccatatcacccaggctggtctcgaactcctggcctcaagtgatccacctgcctcggcctcccaaagtgctgggattataggcgtcagccactatgcccaacccgaccaaccttttttaaaataaatatttaaaaaattggtatttcacatatatactagtatttacatttatccacacaaaacggacgggcctccgctgaaccagtgaggccccagacgtgcgcataaataacccctgcgtgctgcaccacctggggagagggggaggaccacggtaaatggagcgagcgcatagcaaaagggacgcggggtccttttctctgccggtggcactgggtagctgtggccaggtgtggtactttgatggggcccagggctggagctcaaggaagcgtcgcagggtcacagatctgggggaaccccggggaaaagcactgaggcaaaaccgccgctcgtctcctacaatatatgggagggggaggttgagtacgttctggattactcataagaccttttttttttccttccgggcgcaaaaccgtgagctggatttataatcgccctataaagctccagaggcggtcaggcacctgcagaggagccccgccgctccgccgactagctgcccccgcgagcaacggcctcgtgatttccccgccgatccggtccccgcctccccactctgcccccgcctaccccggagccgtgcagccgcctctccgaatctctctcttctcctggcgctcgcgtgcgagagggaactagcgagaacgaggaagcagctggaggtgacgccgggcagattacgcctgtcagggccgagccgagcggatcgctgggcgctgtgcagaggaaaggcgggagtgcccggctcgctgtcgcagagccgaggtgggtaagctagcgaccacctggacttcccagcgcccaaccgtggcttttcagccaggtcctctcctcccgcggcttctcaaccaaccccatcccagcgccggccacccaacctcccgaaatgagtgcttcctgccccagcagccgaaggcgctactaggaacggtaacctgttacttttccaggggccgtagtcgacccgctgcccgagttgctgtgcgactgcgcgcgcggggctagagtgcaaggtgactgtggttcttctctggccaagtccgagggagaacgtaaagatatgggcctttttccccctctcaccttgtctcaccaaagtccctagtccccggagcagttagcctctttctttccagggaattagccagacacaacaacgggaaccagacaccgaaccagacatgcccgccccgtgcgccctccccgctcgctgcctttcctccctcttgtctctccagagccggatcttcaaggggagcctccgtgcccccggctgctcagtccctccggtgtgcaggaccccggaagtcctccccgcacagctctcgcttctctttgcagcctgtttctgcgccggaccagtcgaggactctggacagtagaggccccgggacgaccgagctggaattcgccaccatggccccaaagaagaagcggaaggtcggtatccacggagtcccagcagccctcgaaccaggtgaaaaaccttacaaatgtcctgaatgtgggaaatcattcagtcgcagcgacaacctggtgagacatcaacgcacccatacaggagaaaaaccttataaatgtccagaatgtggaaagtccttctcacgagaggataacttgcacactcatcaacgaacacatactggtgaaaaaccatacaagtgtcccgaatgtggtaaaagttttagccggagcgatgaacttgtccgacaccaacgaacccatacaggcgagaagccttacaaatgtcccgagtgtggcaagagcttctcacaatcagggaatctgactgagcatcaacgaactcataccggggaaaaaccttacaagtgtccagagtgtgggaagagcttttccacaagtggacatctggtacgccaccagaggacacatacaggggagaagccctacaaatgccccgaatgcggtaaaagtttctctcagaatagtaccctgaccgaacaccagcgaacacacactgggaaaaaaacgagtaaaaggccggcggccacgaaaaaggccggccaggcaaaaaagaaaaagggatcctacccatacgacgtaccagattacgctctcgaggacgcgctggacgatttcgatctcgacatgctgggttctgatgccctcgatgactttgacctggatatgttgggaagcgacgcattggatgactttgatctggacatgctcggctccgatgctctggacgatttcgatctcgatatgttataaactagtaagcttgggtggcatccctgtgacccctccccagtgcctctcctggccctggaagttgccactccagtgcccaccagccttgtcctaataaaattaagttgcatcattttgtctgactaggtgtccttctataatattatggggtggaggggggtggtatggagcaaggggcaagttgggaagacaacctgtagggcctgcggggtctattgggaaccaagctggagtgcagtggcacaatcttggctcactgcaatctccgcctcctgggttcaagcgattctcctgcctcagcctcccgagttgttgggattccaggcatgcatgaccaggctcagctaatttttgtttttttggtagagacggggtttcaccatattggccaggctggtctccaactcctaatctcaggtgatctacccaccttggcctcccaaattgctgggattacaggcgtgaaccactgctcccttccctgtcctt

SEQ ID NO: 356 - DNA, 4014 bp, Artificial Sequence
  Description of Artificial Sequence: Synthetic polynucleotide
ggaggaagccatcaactaaactacaatgactgtaagatacaaaattgggaatggtaacatattttgaagttctgttgacataaagaatcatgatattaatgcccatggaaatgaaagggcgatcaacactatggtttgaaaagggggaaattgtagagcacagatgtgttcgtgtggcagtgtgctgtctctagcaatactcagagaagagagagaacaatgaaattctgattggccccagtgtgagcccagatgaggttcagctgccaactttctctttcacatcttatgaaagtcatttaagcacaactaactttttttttttttttttttttttgagacagagtcttgctctgttgcccaggacagagtgcagtagtgactcaatctcggctcactgcagcctccacctcctaggctcaaacggtcctcctgcatcagcctcccaagtagctggaattacaggagtggcccaccatgcccagctaatttttgtatttttaatagatacgggggtttcaccatatcacccaggctggtctcgaactcctggcctcaagtgatccacctgcctcggcctcccaaagtgctgggattataggcgtcagccactatgcccaacccgaccaaccttttttaaaataaatatttaaaaaattggtatttcacatatatactagtatttacatttatccacacaaaacggacgggcctccgctgaaccagtgaggccccagacgtgcgcataaataacccctgcgtgctgcaccacctggggagagggggaggaccacggtaaatggagcgagcgcatagcaaaagggacgcggggtccttttctctgccggtggcactgggtagctgtggccaggtgtggtactttgatggggcccagggctggagctcaaggaagcgtcgcagggtcacagatctgggggaaccccggggaaaagcactgaggcaaaaccgccgctcgtctcctacaatatatgggagggggaggttgagtacgttctggattactcataagaccttttttttttccttccgggcgcaaaaccgtgagctggatttataatcgccctataaagctccagaggcggtcaggcacctgcagaggagccccgccgctccgccgactagctgcccccgcgagcaacggcctcgtgatttccccgccgatccggtccccgcctccccactctgcccccgcctaccccggagccgtgcagccgcctctccgaatctctctcttctcctggcgctcgcgtgcgagagggaactagcgagaacgaggaagcagctggaggtgacgccgggcagattacgcctgtcagggccgagccgagcggatcgctgggcgctgtgcagaggaaaggcgggagtgcccggctcgctgtcgcagagccgaggtgggtaagctagcgaccacctggacttcccagcgcccaaccgtggcttttcagccaggtcctctcctcccgcggcttctcaaccaaccccatcccagcgccggccacccaacctcccgaaatgagtgcttcctgccccagcagccgaaggcgctactaggaacggtaacctgttacttttccaggggccgtagtcgacccgctgcccgagttgctgtgcgactgcgcgcgcggggctagagtgcaaggtgactgtggttcttctctggccaagtccgagggagaacgtaaagatatgggcctttttccccctctcaccttgtctcaccaaagtccctagtccccggagcagttagcctctttctttccagggaattagccagacacaacaacgggaaccagacaccgaaccagacatgcccgccccgtgcgccctccccgctcgctgcctttcctccctcttgtctctccagagccggatcttcaaggggagcctccgtgcccccggctgctcagtccctccggtgtgcaggaccccggaagtcctccccgcacagctctcgcttctctttgcagcctgtttctgcgccggaccagtcgaggactctggacagtagaggccccgggacgaccgagctggaattcgccaccatggccgcggccaaggccgagatgcagctgatgtccccgctgcagatctctgacccgttcggatcctttcctcactcgcccaccatggacaactaccctaagctggaggagatgatgctgctgagcaacggggctccccagttcctcggcgccgccggggccccagagggcagcggcagcaacagcagcagcagcagcagcgggggcggtggaggcggcgggggcggcagcaacagcagcagcagcagcagcaccttcaaccctcaggcggacacgggcgagcagccctacgagcacctgaccgcagagtcttttcctgacatctctctgaacaacgagaaggtgctggtggagaccagttaccccagccaaaccactcgactgccccccatcacctatactggccgcttttccctggagcctgcacccaacagtggcaacaccttgtggcccgagcccctcttcagcttggtcagtggcctagtgagcatgaccaacccaccggcctcctcgtcctcagcaccatctccagcggcctcctccgcctccgcctcccagagcccacccctgagctgcgcagtgccatccaacgacagcagtcccatttactcagcggcacccaccttccccacgccgaacactgacattttccctgagccacaaagccaggccttcccgggctcggcagggacagcgctccagtacccgcctcctgcctaccctgccgccaagggtggcttccaggttcccatgatccccgactacctgtttccacagcagcagggggatctgggcctgggcaccccagaccagaagcccttccagggcctggagagccgcacccagcagccttcgctaacccctctgtctactattaaggcctttgccactcagtcgggctcccaggacctgaaggccctcaataccagctaccagtcccagctcatcaaacccagccgcatgcgcaagtaccccaaccggcccagcaagacgcccccccacgaacgcccttacgcttgcccagtggagtcctgtgatcgccgcttctcccgcagcgacaacctggtgagacacatccgcatccacacaggccagaagcccttccagtgccgcatctgcatgagaaacttcagccgagaggataacttgcacactcacatccgcacccacacaggcgaaaagcccttcgcctgcgacatctgtggaagaaagtttgcccggagcgatgaacttgtccgacataccaagatccacttgcggcagaaggaccgcccttacgcttgcccagtggagtcctgtgatcgccgcttctcccaatcagggaatctgactgagcacatccgcatccacacaggccagaagcccttccagtgccgcatctgcatgagaaacttcagcacaagtggacatctggtacgccacatccgcacccacacaggcgaaaagcccttcgcctgcgacatctgtggaagaaagtttgcccagaatagtaccctgaccgaacataccaagatccacttgcggcagaaggacaagaaagcagacaaaagtgttgtggctagctcggccacctcctctctctcttcctacccgtccccggttgctacctcttacccgtccccggttactacctcttatccatccccggccaccacctcatacccatcccctgtgcccacctccttctcctctcccggctcctcgacctacccatcccctgtgcacagtggcttcccctccccgtcggtggccaccacgtactcctctgttccccctgctttcccggcccaggtcagcagcttcccttcctcagctgtcaccaactccttcagcgcctccacagggctttcggacatgacagcaaccttttctcccaggacaattgaaatttgctaaactagtaataaaagatctttattttcattagatctgtgtgttggttttttgtgtg

SEQ ID NO: 357 - DNA, 3861 bp, Artificial Sequence
  Description of Artificial Sequence: Synthetic polynucleotide
ggaggaagccatcaactaaactacaatgactgtaagatacaaaattgggaatggtaacatattttgaagttctgttgacataaagaatcatgatattaatgcccatggaaatgaaagggcgatcaacactatggtttgaaaagggggaaattgtagagcacagatgtgttcgtgtggcagtgtgctgtctctagcaatactcagagaagagagagaacaatgaaattctgattggccccagtgtgagcccagatgaggttcagctgccaactttctctttcacatcttatgaaagtcatttaagcacaactaactttttttttttttttttttttttgagacagagtcttgctctgttgcccaggacagagtgcagtagtgactcaatctcggctcactgcagcctccacctcctaggctcaaacggtcctcctgcatcagcctcccaagtagctggaattacaggagtggcccaccatgcccagctaatttttgtatttttaatagatacgggggtttcaccatatcacccaggctggtctcgaactcctggcctcaagtgatccacctgcctcggcctcccaaagtgctgggattataggcgtcagccactatgcccaacccgaccaaccttttttaaaataaatatttaaaaaattggtatttcacatatatactagtatttacatttatccacacaaaacggacgggcctccgctgaaccagtgaggccccagacgtgcgcataaataacccctgcgtgctgcaccacctggggagagggggaggaccacggtaaatggagcgagcgcatagcaaaagggacgcggggtccttttctctgccggtggcactgggtagctgtggccaggtgtggtactttgatggggcccagggctggagctcaaggaagcgtcgcagggtcacagatctgggggaaccccggggaaaagcactgaggcaaaaccgccgctcgtctcctacaatatatgggagggggaggttgagtacgttctggattactcataagaccttttttttttccttccgggcgcaaaaccgtgagctggatttataatcgccctataaagctccagaggcggtcaggcacctgcagaggagccccgccgctccgccgactagctgcccccgcgagcaacggcctcgtgatttccccgccgatccggtccccgcctccccactctgcccccgcctaccccggagccgtgcagccgcctctccgaatctctctcttctcctggcgctcgcgtgcgagagggaactagcgagaacgaggaagcagctggaggtgacgccgggcagattacgcctgtcagggccgagccgagcggatcgctgggcgctgtgcagaggaaaggcgggagtgcccggctcgctgtcgcagagccgaggtgggtaagctagcgaccacctggacttcccagcgcccaaccgtggcttttcagccaggtcctctcctcccgcggcttctcaaccaaccccatcccagcgccggccacccaacctcccgaaatgagtgcttcctgccccagcagccgaaggcgctactaggaacggtaacctgttacttttccaggggccgtagtcgacccgctgcccgagttgctgtgcgactgcgcgcgcggggctagagtgcaaggtgactgtggttcttctctggccaagtccgagggagaacgtaaagatatgggcctttttccccctctcaccttgtctcaccaaagtccctagtccccggagcagttagcctctttctttccagggaattagccagacacaacaacgggaaccagacaccgaaccagacatgcccgccccgtgcgccctccccgctcgctgcctttcctccctcttgtctctccagagccggatcttcaaggggagcctccgtgcccccggctgctcagtccctccggtgtgcaggaccccggaagtcctccccgcacagctctcgcttctctttgcagcctgtttctgcgccggaccagtcgaggactctggacagtagaggccccgggacgaccgagctggaattcgccaccatggccgccgaccacctgatgctcgccgagggctaccgcctggtgcagaggccgccgtccgccgccgccgcccatggccctcatgcgctccggactctgccgccgtacgcgggcccgggcctggacagtgggctgaggccgcggggggctccgctggggccgccgccgccccgccaacccggggccctggcgtacggggccttcgggccgccgtcctccttccagccctttccggccgtgcctccgccggccgcgggcatcgcgcacctgcagcctgtggcgacgccgtaccccggccgcgcggccgcgccccccaacgctccgggaggccccccgggcccgcagccggccccaagcgccgcagccccgccgccgcccgcgcacgccctgggcggcatggacgccgaactcatcgacgaggaggcgctgacgtcgctggagctggagctggggctgcaccgcgtgcgcgagctgcccgagctgttcctgggccagagcgagttcgactgcttctcggacttggggtccgcgccgcccgccggctccgtgagctgcggtggttctggtggtggttctggtcagtcccagctcatcaaacccagccgcatgcgcaagtaccccaaccggcccagcaagacgcccccccacgaacgcccttacgcttgcccagtggagtcctgtgatcgccgcttctcccgcagcgacaacctggtgagacacatccgcatccacacaggccagaagcccttccagtgccgcatctgcatgagaaacttcagccgagaggataacttgcacactcacatccgcacccacacaggcgaaaagcccttcgcctgcgacatctgtggaagaaagtttgcccggagcgatgaacttgtccgacataccaagatccacttgcggcagaaggaccgcccttacgcttgcccagtggagtcctgtgatcgccgcttctcccaatcagggaatctgactgagcacatccgcatccacacaggccagaagcccttccagtgccgcatctgcatgagaaacttcagcacaagtggacatctggtacgccacatccgcacccacacaggcgaaaagcccttcgcctgcgacatctgtggaagaaagtttgcccagaatagtaccctgaccgaacataccaagatccacttgcggcagaaggacaagctcgagatggccgaccacctgatgctcgccgagggctaccgcctggtgcagaggccgccgtccgccgccgccgcccatggccctcatgcgctccggactctgccgccgtacgcgggcccgggcctggacagtgggctgaggccgcggggggctccgctggggccgccgccgccccgccaacccggggccctggcgtacggggccttcgggccgccgtcctccttccagccctttccggccgtgcctccgccggccgcgggcatcgcgcacctgcagcctgtggcgacgccgtaccccggccgcgcggccgcgccccccaacgctccgggaggccccccgggcccgcagccggccccaagcgccgcagccccgccgccgcccgcgcacgccctgggcggcatggacgccgaactcatcgacgaggaggcgctgacgtcgctggagctggagctggggctgcaccgcgtgcgcgagctgcccgagctgttcctgggccagagcgagttcgactgcttctcggacttggggtccgcgccgcccgccggctccgtgagctgctaaactagtaataaaagatctttattttcattagatctgtgtgttggttttttgtgtg

SEQ ID NO: 358 - DNA, 4002 bp, Artificial Sequence
  Description of Artificial Sequence: Synthetic polynucleotide
ggaggaagccatcaactaaactacaatgactgtaagatacaaaattgggaatggtaacatattttgaagttctgttgacataaagaatcatgatattaatgcccatggaaatgaaagggcgatcaacactatggtttgaaaagggggaaattgtagagcacagatgtgttcgtgtggcagtgtgctgtctctagcaatactcagagaagagagagaacaatgaaattctgattggccccagtgtgagcccagatgaggttcagctgccaactttctctttcacatcttatgaaagtcatttaagcacaactaactttttttttttttttttttttttgagacagagtcttgctctgttgcccaggacagagtgcagtagtgactcaatctcggctcactgcagcctccacctcctaggctcaaacggtcctcctgcatcagcctcccaagtagctggaattacaggagtggcccaccatgcccagctaatttttgtatttttaatagatacgggggtttcaccatatcacccaggctggtctcgaactcctggcctcaagtgatccacctgcctcggcctcccaaagtgctgggattataggcgtcagccactatgcccaacccgaccaaccttttttaaaataaatatttaaaaaattggtatttcacatatatactagtatttacatttatccacacaaaacggacgggcctccgctgaaccagtgaggccccagacgtgcgcataaataacccctgcgtgctgcaccacctggggagagggggaggaccacggtaaatggagcgagcgcatagcaaaagggacgcggggtccttttctctgccggtggcactgggtagctgtggccaggtgtggtactttgatggggcccagggctggagctcaaggaagcgtcgcagggtcacagatctgggggaaccccggggaaaagcactgaggcaaaaccgccgctcgtctcctacaatatatgggagggggaggttgagtacgttctggattactcataagaccttttttttttccttccgggcgcaaaaccgtgagctggatttataatcgccctataaagctccagaggcggtcaggcacctgcagaggagccccgccgctccgccgactagctgcccccgcgagcaacggcctcgtgatttccccgccgatccggtccccgcctccccactctgcccccgcctaccccggagccgtgcagccgcctctccgaatctctctcttctcctggcgctcgcgtgcgagagggaactagcgagaacgaggaagcagctggaggtgacgccgggcagattacgcctgtcagggccgagccgagcggatcgctgggcgctgtgcagaggaaaggcgggagtgcccggctcgctgtcgcagagccgaggtgggtaagctagcgaccacctggacttcccagcgcccaaccgtggcttttcagccaggtcctctcctcccgcggcttctcaaccaaccccatcccagcgccggccacccaacctcccgaaatgagtgcttcctgccccagcagccgaaggcgctactaggaacggtaacctgttacttttccaggggccgtagtcgacccgctgcccgagttgctgtgcgactgcgcgcgcggggctagagtgcaaggtgactgtggttcttctctggccaagtccgagggagaacgtaaagatatgggcctttttccccctctcaccttgtctcaccaaagtccctagtccccggagcagttagcctctttctttccagggaattagccagacacaacaacgggaaccagacaccgaaccagacatgcccgccccgtgcgccctccccgctcgctgcctttcctccctcttgtctctccagagccggatcttcaaggggagcctccgtgcccccggctgctcagtccctccggtgtgcaggaccccggaagtcctccccgcacagctctcgcttctctttgcagcctgtttctgcgccggaccagtcgaggactctggacagtagaggccccgggacgaccgagctggaattcgccaccatggccgcggccaaggccgagatgcagctgatgtccccgctgcagatctctgacccgttcggatcctttcctcactcgcccaccatggacaactaccctaagctggaggagatgatgctgctgagcaacggggctccccagttcctcggcgccgccggggccccagagggcagcggcagcaacagcagcagcagcagcagcgggggcggtggaggcggcgggggcggcagcaacagcagcagcagcagcagcaccttcaaccctcaggcggacacgggcgagcagccctacgagcacctgaccgcagagtcttttcctgacatctctctgaacaacgagaaggtgctggtggagaccagttaccccagccaaaccactcgactgccccccatcacctatactggccgcttttccctggagcctgcacccaacagtggcaacaccttgtggcccgagcccctcttcagcttggtcagtggcctagtgagcatgaccaacccaccggcctcctcgtcctcagcaccatctccagcggcctcctccgcctccgcctcccagagcccacccctgagctgcgcagtgccatccaacgacagcagtcccatttactcagcggcacccaccttccccacgccgaacactgacattttccctgagccacaaagccaggccttcccgggctcggcagggacagcgctccagtacccgcctcctgcctaccctgccgccaagggtggcttccaggttcccatgatccccgactacctgtttccacagcagcagggggatctgggcctgggcaccccagaccagaagcccttccagggcctggagagccgcacccagcagccttcgctaacccctctgtctactattaaggcctttgccactcagtcgggctcccaggacctgaaggccctcaataccagctaccagtcccagctcatcaaacccagccgcatgcgcaagtaccccaaccggcccagcaagacgcccccccacgaacgcccttacgcttgcccagtggagtcctgtgatcgccgcttctcccgctcagacaacctcgttcgacacatccgcatccacacaggccagaagcccttccagtgccgcatctgcatgagaaacttcagccaccggactacactcacgaaccacatccgcacccacacaggcgaaaagcccttcgcctgcgacatctgtggaagaaagtttgccagagaagacaatctccatactcacatccggacacacacgggagagaagccattcgcatgtgatatatgtgggagaaagttctccaccagccattctctcactgaacacatccgcatccacacaggccagaagcccttccagtgccgcatctgcatgagaaacttcagccagtctagctcactggtgaggcacatccgcacccacacaggcgaaaagcccttcgcctgcgacatctgtggaagaaagtttgccagggaggataacctgcatacgcataccaagatccacttgcggcagaaggacaagaaagcagacaaaagtgttgtggctagctcggccacctcctctctctcttcctacccgtccccggttgctacctcttacccgtccccggttactacctcttatccatccccggccaccacctcatacccatcccctgtgcccacctccttctcctctcccggctcctcgacctacccatcccctgtgcacagtggcttcccctccccgtcggtggccaccacgtactcctctgttccccctgctttcccggcccaggtcagcagcttcccttcctcagctgtcaccaactccttcagcgcctccacagggctttcggacatgacagcaaccttttctcccaggacaattgaaatttgctaaactagtaataaaagatctttattttcattagatctgtgtgttggttttttgtgtg

SEQ ID NO: 359 - DNA, 3309 bp, Artificial Sequence
  Description of Artificial Sequence: Synthetic polynucleotide
ggaggaagccatcaactaaactacaatgactgtaagatacaaaattgggaatggtaacatattttgaagttctgttgacataaagaatcatgatattaatgcccatggaaatgaaagggcgatcaacactatggtttgaaaagggggaaattgtagagcacagatgtgttcgtgtggcagtgtgctgtctctagcaatactcagagaagagagagaacaatgaaattctgattggccccagtgtgagcccagatgaggttcagctgccaactttctctttcacatcttatgaaagtcatttaagcacaactaactttttttttttttttttttttttgagacagagtcttgctctgttgcccaggacagagtgcagtagtgactcaatctcggctcactgcagcctccacctcctaggctcaaacggtcctcctgcatcagcctcccaagtagctggaattacaggagtggcccaccatgcccagctaatttttgtatttttaatagatacgggggtttcaccatatcacccaggctggtctcgaactcctggcctcaagtgatccacctgcctcggcctcccaaagtgctgggattataggcgtcagccactatgcccaacccgaccaaccttttttaaaataaatatttaaaaaattggtatttcacatatatactagtatttacatttatccacacaaaacggacgggcctccgctgaaccagtgaggccccagacgtgcgcataaataacccctgcgtgctgcaccacctggggagagggggaggaccacggtaaatggagcgagcgcatagcaaaagggacgcggggtccttttctctgccggtggcactgggtagctgtggccaggtgtggtactttgatggggcccagggctggagctcaaggaagcgtcgcagggtcacagatctgggggaaccccggggaaaagcactgaggcaaaaccgccgctcgtctcctacaatatatgggagggggaggttgagtacgttctggattactcataagaccttttttttttccttccgggcgcaaaaccgtgagctggatttataatcgccctataaagctccagaggcggtcaggcacctgcagaggagccccgccgctccgccgactagctgcccccgcgagcaacggcctcgtgatttccccgccgatccggtccccgcctccccactctgcccccgcctaccccggagccgtgcagccgcctctccgaatctctctcttctcctggcgctcgcgtgcgagagggaactagcgagaacgaggaagcagctggaggtgacgccgggcagattacgcctgtcagggccgagccgagcggatcgctgggcgctgtgcagaggaaaggcgggagtgcccggctcgctgtcgcagagccgaggtgggtaagctagcgaccacctggacttcccagcgcccaaccgtggcttttcagccaggtcctctcctcccgcggcttctcaaccaaccccatcccagcgccggccacccaacctcccgaaatgagtgcttcctgccccagcagccgaaggcgctactaggaacggtaacctgttacttttccaggggccgtagtcgacccgctgcccgagttgctgtgcgactgcgcgcgcggggctagagtgcaaggtgactgtggttcttctctggccaagtccgagggagaacgtaaagatatgggcctttttccccctctcaccttgtctcaccaaagtccctagtccccggagcagttagcctctttctttccagggaattagccagacacaacaacgggaaccagacaccgaaccagacatgcccgccccgtgcgccctccccgctcgctgcctttcctccctcttgtctctccagagccggatcttcaaggggagcctccgtgcccccggctgctcagtccctccggtgtgcaggaccccggaagtcctccccgcacagctctcgcttctctttgcagcctgtttctgcgccggaccagtcgaggactctggacagtagaggccccgggacgaccgagctggaattcgccaccatggccgccgaccacctgatgctcgccgagggctaccgcctggtgcagaggccgccgtccgccgccgccgcccatggccctcatgcgctccggactctgccgccgtacgcgggcccgggcctggacagtgggctgaggccgcggggggctccgctggggccgccgccgccccgccaacccggggccctggcgtacggggccttcgggccgccgtcctccttccagccctttccggccgtgcctccgccggccgcgggcatcgcgcacctgcagcctgtggcgacgccgtaccccggccgcgcggccgcgccccccaacgctccgggaggccccccgggcccgcagccggccccaagcgccgcagccccgccgccgcccgcgcacgccctgggcggcatggacgccgaactcatcgacgaggaggcgctgacgtcgctggagctggagctggggctgcaccgcgtgcgcgagctgcccgagctgttcctgggccagagcgagttcgactgcttctcggacttggggtccgcgccgcccgccggctccgtgagctgcggtggttctggtggtggttctggtcagtcccagctcatcaaacccagccgcatgcgcaagtaccccaaccggcccagcaagacgcccccccacgaacgcccttacgcttgcccagtggagtcctgtgatcgccgcttctcccgcagcgacaacctggtgagacacatccgcatccacacaggccagaagcccttccagtgccgcatctgcatgagaaacttcagccgagaggataacttgcacactcacatccgcacccacacaggcgaaaagcccttcgcctgcgacatctgtggaagaaagtttgcccggagcgatgaacttgtccgacataccaagatccacttgcggcagaaggaccgcccttacgcttgcccagtggagtcctgtgatcgccgcttctcccaatcagggaatctgactgagcacatccgcatccacacaggccagaagcccttccagtgccgcatctgcatgagaaacttcagcacaagtggacatctggtacgccacatccgcacccacacaggcgaaaagcccttcgcctgcgacatctgtggaagaaagtttgcccagaatagtaccctgaccgaacataccaagatccacttgcggcagaaggacaagtaactcgagactagtaataaaagatctttattttcattagatctgtgtgttggttttttgtgtg

SEQ ID NO: 360 - DNA, 3861 bp, Artificial Sequence
  Description of Artificial Sequence: Synthetic polynucleotide
ggaggaagccatcaactaaactacaatgactgtaagatacaaaattgggaatggtaacatattttgaagttctgttgacataaagaatcatgatattaatgcccatggaaatgaaagggcgatcaacactatggtttgaaaagggggaaattgtagagcacagatgtgttcgtgtggcagtgtgctgtctctagcaatactcagagaagagagagaacaatgaaattctgattggccccagtgtgagcccagatgaggttcagctgccaactttctctttcacatcttatgaaagtcatttaagcacaactaactttttttttttttttttttttttgagacagagtcttgctctgttgcccaggacagagtgcagtagtgactcaatctcggctcactgcagcctccacctcctaggctcaaacggtcctcctgcatcagcctcccaagtagctggaattacaggagtggcccaccatgcccagctaatttttgtatttttaatagatacgggggtttcaccatatcacccaggctggtctcgaactcctggcctcaagtgatccacctgcctcggcctcccaaagtgctgggattataggcgtcagccactatgcccaacccgaccaaccttttttaaaataaatatttaaaaaattggtatttcacatatatactagtatttacatttatccacacaaaacggacgggcctccgctgaaccagtgaggccccagacgtgcgcataaataacccctgcgtgctgcaccacctggggagagggggaggaccacggtaaatggagcgagcgcatagcaaaagggacgcggggtccttttctctgccggtggcactgggtagctgtggccaggtgtggtactttgatggggcccagggctggagctcaaggaagcgtcgcagggtcacagatctgggggaaccccggggaaaagcactgaggcaaaaccgccgctcgtctcctacaatatatgggagggggaggttgagtacgttctggattactcataagaccttttttttttccttccgggcgcaaaaccgtgagctggatttataatcgccctataaagctccagaggcggtcaggcacctgcagaggagccccgccgctccgccgactagctgcccccgcgagcaacggcctcgtgatttccccgccgatccggtccccgcctccccactctgcccccgcctaccccggagccgtgcagccgcctctccgaatctctctcttctcctggcgctcgcgtgcgagagggaactagcgagaacgaggaagcagctggaggtgacgccgggcagattacgcctgtcagggccgagccgagcggatcgctgggcgctgtgcagaggaaaggcgggagtgcccggctcgctgtcgcagagccgaggtgggtaagctagcgaccacctggacttcccagcgcccaaccgtggcttttcagccaggtcctctcctcccgcggcttctcaaccaaccccatcccagcgccggccacccaacctcccgaaatgagtgcttcctgccccagcagccgaaggcgctactaggaacggtaacctgttacttttccaggggccgtagtcgacccgctgcccgagttgctgtgcgactgcgcgcgcggggctagagtgcaaggtgactgtggttcttctctggccaagtccgagggagaacgtaaagatatgggcctttttccccctctcaccttgtctcaccaaagtccctagtccccggagcagttagcctctttctttccagggaattagccagacacaacaacgggaaccagacaccgaaccagacatgcccgccccgtgcgccctccccgctcgctgcctttcctccctcttgtctctccagagccggatcttcaaggggagcctccgtgcccccggctgctcagtccctccggtgtgcaggaccccggaagtcctccccgcacagctctcgcttctctttgcagcctgtttctgcgccggaccagtcgaggactctggacagtagaggccccgggacgaccgagctggaattcgccaccatggccgccgaccacctgatgctcgccgagggctaccgcctggtgcagaggccgccgtccgccgccgccgcccatggccctcatgcgctccggactctgccgccgtacgcgggcccgggcctggacagtgggctgaggccgcggggggctccgctggggccgccgccgccccgccaacccggggccctggcgtacggggccttcgggccgccgtcctccttccagccctttccggccgtgcctccgccggccgcgggcatcgcgcacctgcagcctgtggcgacgccgtaccccggccgcgcggccgcgccccccaacgctccgggaggccccccgggcccgcagccggccccaagcgccgcagccccgccgccgcccgcgcacgccctgggcggcatggacgccgaactcatcgacgaggaggcgctgacgtcgctggagctggagctggggctgcaccgcgtgcgcgagctgcccgagctgttcctgggccagagcgagttcgactgcttctcggacttggggtccgcgccgcccgccggctccgtgagctgcggtggttctggtggtggttctggtcagtcccagctcatcaaacccagccgcatgcgcaagtaccccaaccggcccagcaagacgcccccccacgaacgcccttacgcttgcccagtggagtcctgtgatcgccgcttctcccgctcagacaacctcgttcgacacatccgcatccacacaggccagaagcccttccagtgccgcatctgcatgagaaacttcagccaccggactacactcacgaaccacatccgcacccacacaggcgaaaagcccttcgcctgcgacatctgtggaagaaagtttgccagagaagacaatctccatactcataccaagatccacttgcggcagaaggaccgcccttacgcttgcccagtggagtcctgtgatcgccgcttctccaccagccattctctcactgaacacatccgcatccacacaggccagaagcccttccagtgccgcatctgcatgagaaacttcagccagtctagctcactggtgaggcacatccgcacccacacaggcgaaaagcccttcgcctgcgacatctgtggaagaaagtttgccagggaggataacctgcatacgcataccaagatccacttgcggcagaaggacaagctcgagatggccgaccacctgatgctcgccgagggctaccgcctggtgcagaggccgccgtccgccgccgccgcccatggccctcatgcgctccggactctgccgccgtacgcgggcccgggcctggacagtgggctgaggccgcggggggctccgctggggccgccgccgccccgccaacccggggccctggcgtacggggccttcgggccgccgtcctccttccagccctttccggccgtgcctccgccggccgcgggcatcgcgcacctgcagcctgtggcgacgccgtaccccggccgcgcggccgcgccccccaacgctccgggaggccccccgggcccgcagccggccccaagcgccgcagccccgccgccgcccgcgcacgccctgggcggcatggacgccgaactcatcgacgaggaggcgctgacgtcgctggagctggagctggggctgcaccgcgtgcgcgagctgcccgagctgttcctgggccagagcgagttcgactgcttctcggacttggggtccgcgccgcccgccggctccgtgagctgctaaactagtaataaaagatctttattttcattagatctgtgtgttggttttttgtgtg

SEQ ID NO: 361 - DNA, 3309 bp, Artificial Sequence
  Description of Artificial Sequence: Synthetic polynucleotide
ggaggaagccatcaactaaactacaatgactgtaagatacaaaattgggaatggtaacatattttgaagttctgttgacataaagaatcatgatattaatgcccatggaaatgaaagggcgatcaacactatggtttgaaaagggggaaattgtagagcacagatgtgttcgtgtggcagtgtgctgtctctagcaatactcagagaagagagagaacaatgaaattctgattggccccagtgtgagcccagatgaggttcagctgccaactttctctttcacatcttatgaaagtcatttaagcacaactaactttttttttttttttttttttttgagacagagtcttgctctgttgcccaggacagagtgcagtagtgactcaatctcggctcactgcagcctccacctcctaggctcaaacggtcctcctgcatcagcctcccaagtagctggaattacaggagtggcccaccatgcccagctaatttttgtatttttaatagatacgggggtttcaccatatcacccaggctggtctcgaactcctggcctcaagtgatccacctgcctcggcctcccaaagtgctgggattataggcgtcagccactatgcccaacccgaccaaccttttttaaaataaatatttaaaaaattggtatttcacatatatactagtatttacatttatccacacaaaacggacgggcctccgctgaaccagtgaggccccagacgtgcgcataaataacccctgcgtgctgcaccacctggggagagggggaggaccacggtaaatggagcgagcgcatagcaaaagggacgcggggtccttttctctgccggtggcactgggtagctgtggccaggtgtggtactttgatggggcccagggctggagctcaaggaagcgtcgcagggtcacagatctgggggaaccccggggaaaagcactgaggcaaaaccgccgctcgtctcctacaatatatgggagggggaggttgagtacgttctggattactcataagaccttttttttttccttccgggcgcaaaaccgtgagctggatttataatcgccctataaagctccagaggcggtcaggcacctgcagaggagccccgccgctccgccgactagctgcccccgcgagcaacggcctcgtgatttccccgccgatccggtccccgcctccccactctgcccccgcctaccccggagccgtgcagccgcctctccgaatctctctcttctcctggcgctcgcgtgcgagagggaactagcgagaacgaggaagcagctggaggtgacgccgggcagattacgcctgtcagggccgagccgagcggatcgctgggcgctgtgcagaggaaaggcgggagtgcccggctcgctgtcgcagagccgaggtgggtaagctagcgaccacctggacttcccagcgcccaaccgtggcttttcagccaggtcctctcctcccgcggcttctcaaccaaccccatcccagcgccggccacccaacctcccgaaatgagtgcttcctgccccagcagccgaaggcgctactaggaacggtaacctgttacttttccaggggccgtagtcgacccgctgcccgagttgctgtgcgactgcgcgcgcggggctagagtgcaaggtgactgtggttcttctctggccaagtccgagggagaacgtaaagatatgggcctttttccccctctcaccttgtctcaccaaagtccctagtccccggagcagttagcctctttctttccagggaattagccagacacaacaacgggaaccagacaccgaaccagacatgcccgccccgtgcgccctccccgctcgctgcctttcctccctcttgtctctccagagccggatcttcaaggggagcctccgtgcccccggctgctcagtccctccggtgtgcaggaccccggaagtcctccccgcacagctctcgcttctctttgcagcctgtttctgcgccggaccagtcgaggactctggacagtagaggccccgggacgaccgagctggaattcgccaccatggccgccgaccacctgatgctcgccgagggctaccgcctggtgcagaggccgccgtccgccgccgccgcccatggccctcatgcgctccggactctgccgccgtacgcgggcccgggcctggacagtgggctgaggccgcggggggctccgctggggccgccgccgccccgccaacccggggccctggcgtacggggccttcgggccgccgtcctccttccagccctttccggccgtgcctccgccggccgcgggcatcgcgcacctgcagcctgtggcgacgccgtaccccggccgcgcggccgcgccccccaacgctccgggaggccccccgggcccgcagccggccccaagcgccgcagccccgccgccgcccgcgcacgccctgggcggcatggacgccgaactcatcgacgaggaggcgctgacgtcgctggagctggagctggggctgcaccgcgtgcgcgagctgcccgagctgttcctgggccagagcgagttcgactgcttctcggacttggggtccgcgccgcccgccggctccgtgagctgcggtggttctggtggtggttctggtcagtcccagctcatcaaacccagccgcatgcgcaagtaccccaaccggcccagcaagacgcccccccacgaacgcccttacgcttgcccagtggagtcctgtgatcgccgcttctcccgctcagacaacctcgttcgacacatccgcatccacacaggccagaagcccttccagtgccgcatctgcatgagaaacttcagccaccggactacactcacgaaccacatccgcacccacacaggcgaaaagcccttcgcctgcgacatctgtggaagaaagtttgccagagaagacaatctccatactcataccaagatccacttgcggcagaaggaccgcccttacgcttgcccagtggagtcctgtgatcgccgcttctccaccagccattctctcactgaacacatccgcatccacacaggccagaagcccttccagtgccgcatctgcatgagaaacttcagccagtctagctcactggtgaggcacatccgcacccacacaggcgaaaagcccttcgcctgcgacatctgtggaagaaagtttgccagggaggataacctgcatacgcataccaagatccacttgcggcagaaggacaagtaactcgagactagtaataaaagatctttattttcattagatctgtgtgttggttttttgtgtg

SEQ ID NO: 362 - DNA, 4448 bp, Artificial Sequence
  Description of Artificial Sequence: Synthetic polynucleotide
ggaggaagccatcaactaaactacaatgactgtaagatacaaaattgggaatggtaacatattttgaagttctgttgacataaagaatcatgatattaatgcccatggaaatgaaagggcgatcaacactatggtttgaaaagggggaaattgtagagcacagatgtgttcgtgtggcagtgtgctgtctctagcaatactcagagaagagagagaacaatgaaattctgattggccccagtgtgagcccagatgaggttcagctgccaactttctctttcacatcttatgaaagtcatttaagcacaactaactttttttttttttttttttttttgagacagagtcttgctctgttgcccaggacagagtgcagtagtgactcaatctcggctcactgcagcctccacctcctaggctcaaacggtcctcctgcatcagcctcccaagtagctggaattacaggagtggcccaccatgcccagctaatttttgtatttttaatagatacgggggtttcaccatatcacccaggctggtctcgaactcctggcctcaagtgatccacctgcctcggcctcccaaagtgctgggattataggcgtcagccactatgcccaacccgaccaaccttttttaaaataaatatttaaaaaattggtatttcacatatatactagtatttacatttatccacacaaaacggacgggcctccgctgaaccagtgaggccccagacgtgcgcataaataacccctgcgtgctgcaccacctggggagagggggaggaccacggtaaatggagcgagcgcatagcaaaagggacgcggggtccttttctctgccggtggcactgggtagctgtggccaggtgtggtactttgatggggcccagggctggagctcaaggaagcgtcgcagggtcacagatctgggggaaccccggggaaaagcactgaggcaaaaccgccgctcgtctcctacaatatatgggagggggaggttgagtacgttctggattactcataagaccttttttttttccttccgggcgcaaaaccgtgagctggatttataatcgccctataaagctccagaggcggtcaggcacctgcagaggagccccgccgctccgccgactagctgcccccgcgagcaacggcctcgtgatttccccgccgatccggtccccgcctccccactctgcccccgcctaccccggagccgtgcagccgcctctccgaatctctctcttctcctggcgctcgcgtgcgagagggaactagcgagaacgaggaagcagctggaggtgacgccgggcagattacgcctgtcagggccgagccgagcggatcgctgggcgctgtgcagaggaaaggcgggagtgcccggctcgctgtcgcagagccgaggtgggtaagctagcgaccacctggacttcccagcgcccaaccgtggcttttcagccaggtcctctcctcccgcggcttctcaaccaaccccatcccagcgccggccacccaacctcccgaaatgagtgcttcctgccccagcagccgaaggcgctactaggaacggtaacctgttacttttccaggggccgtagtcgacccgctgcccgagttgctgtgcgactgcgcgcgcggggctagagtgcaaggtgactgtggttcttctctggccaagtccgagggagaacgtaaagatatgggcctttttccccctctcaccttgtctcaccaaagtccctagtccccggagcagttagcctctttctttccagggaattagccagacacaacaacgggaaccagacaccgaaccagacatgcccgccccgtgcgccctccccgctcgctgcctttcctccctcttgtctctccagagccggatcttcaaggggagcctccgtgcccccggctgctcagtccctccggtgtgcaggaccccggaagtcctccccgcacagctctcgcttctctttgcagcctgtttctgcgccggaccagtcgaggactctggacagtagaggccccgggacgaccgagctggaattcgccaccatggccgcggccaaggccgagatgcagctgatgtccccgctgcagatctctgacccgttcggatcctttcctcactcgcccaccatggacaactaccctaagctggaggagatgatgctgctgagcaacggggctccccagttcctcggcgccgccggggccccagagggcagcggcagcaacagcagcagcagcagcagcgggggcggtggaggcggcgggggcggcagcaacagcagcagcagcagcagcaccttcaaccctcaggcggacacgggcgagcagccctacgagcacctgaccgcagagtcttttcctgacatctctctgaacaacgagaaggtgctggtggagaccagttaccccagccaaaccactcgactgccccccatcacctatactggccgcttttccctggagcctgcacccaacagtggcaacaccttgtggcccgagcccctcttcagcttggtcagtggcctagtgagcatgaccaacccaccggcctcctcgtcctcagcaccatctccagcggcctcctccgcctccgcctcccagagcccacccctgagctgcgcagtgccatccaacgacagcagtcccatttactcagcggcacccaccttccccacgccgaacactgacattttccctgagccacaaagccaggccttcccgggctcggcagggacagcgctccagtacccgcctcctgcctaccctgccgccaagggtggcttccaggttcccatgatccccgactacctgtttccacagcagcagggggatctgggcctgggcaccccagaccagaagcccttccagggcctggagagccgcacccagcagccttcgctaacccctctgtctactattaaggcctttgccactcagtcgggctcccaggacctgaaggccctcaataccagctaccagtcccagctcatcaaacccagccgcatgcgcaagtaccccaaccggcccagcaagacgcccccccacgaacgcccttacgcttgcccagtggagtcctgtgatcgccgcttctcccgcagcgacaacctggtgagacacatccgcatccacacaggccagaagcccttccagtgccgcatctgcatgagaaacttcagccgagaggataacttgcacactcacatccgcacccacacaggcgaaaagcccttcgcctgcgacatctgtggaagaaagtttgcccggagcgatgaacttgtccgacataccaagatccacttgcggcagaaggaccgcccttacgcttgcccagtggagtcctgtgatcgccgcttctcccaatcagggaatctgactgagcacatccgcatccacacaggccagaagcccttccagtgccgcatctgcatgagaaacttcagcacaagtggacatctggtacgccacatccgcacccacacaggcgaaaagcccttcgcctgcgacatctgtggaagaaagtttgcccagaatagtaccctgaccgaacataccaagatccacttgcggcagaaggacaagaaagcagacaaaagtgttgtggctagctcggccacctcctctctctcttcctacccgtccccggttgctacctcttacccgtccccggttactacctcttatccatccccggccaccacctcatacccatcccctgtgcccacctccttctcctctcccggctcctcgacctacccatcccctgtgcacagtggcttcccctccccgtcggtggccaccacgtactcctctgttccccctgctttcccggcccaggtcagcagcttcccttcctcagctgtcaccaactccttcagcgcctccacagggctttcggacatgacagcaaccttttctcccaggacaattgaaatttgctaaactagtaagcttgggtggcatccctgtgacccctccccagtgcctctcctggccctggaagttgccactccagtgcccaccagccttgtcctaataaaattaagttgcatcattttgtctgactaggtgtccttctataatattatggggtggaggggggtggtatggagcaaggggcaagttgggaagacaacctgtagggcctgcggggtctattgggaaccaagctggagtgcagtggcacaatcttggctcactgcaatctccgcctcctgggttcaagcgattctcctgcctcagcctcccgagttgttgggattccaggcatgcatgaccaggctcagctaatttttgtttttttggtagagacggggtttcaccatattggccaggctggtctccaactcctaatctcaggtgatctacccaccttggcctcccaaattgctgggattacaggcgtgaaccactgctcccttccctgtcctt

SEQ ID NO: 363 - DNA, 4436 bp, Artificial Sequence
  Description of Artificial Sequence: Synthetic polynucleotide
ggaggaagccatcaactaaactacaatgactgtaagatacaaaattgggaatggtaacatattttgaagttctgttgacataaagaatcatgatattaatgcccatggaaatgaaagggcgatcaacactatggtttgaaaagggggaaattgtagagcacagatgtgttcgtgtggcagtgtgctgtctctagcaatactcagagaagagagagaacaatgaaattctgattggccccagtgtgagcccagatgaggttcagctgccaactttctctttcacatcttatgaaagtcatttaagcacaactaactttttttttttttttttttttttgagacagagtcttgctctgttgcccaggacagagtgcagtagtgactcaatctcggctcactgcagcctccacctcctaggctcaaacggtcctcctgcatcagcctcccaagtagctggaattacaggagtggcccaccatgcccagctaatttttgtatttttaatagatacgggggtttcaccatatcacccaggctggtctcgaactcctggcctcaagtgatccacctgcctcggcctcccaaagtgctgggattataggcgtcagccactatgcccaacccgaccaaccttttttaaaataaatatttaaaaaattggtatttcacatatatactagtatttacatttatccacacaaaacggacgggcctccgctgaaccagtgaggccccagacgtgcgcataaataacccctgcgtgctgcaccacctggggagagggggaggaccacggtaaatggagcgagcgcatagcaaaagggacgcggggtccttttctctgccggtggcactgggtagctgtggccaggtgtggtactttgatggggcccagggctggagctcaaggaagcgtcgcagggtcacagatctgggggaaccccggggaaaagcactgaggcaaaaccgccgctcgtctcctacaatatatgggagggggaggttgagtacgttctggattactcataagaccttttttttttccttccgggcgcaaaaccgtgagctggatttataatcgccctataaagctccagaggcggtcaggcacctgcagaggagccccgccgctccgccgactagctgcccccgcgagcaacggcctcgtgatttccccgccgatccggtccccgcctccccactctgcccccgcctaccccggagccgtgcagccgcctctccgaatctctctcttctcctggcgctcgcgtgcgagagggaactagcgagaacgaggaagcagctggaggtgacgccgggcagattacgcctgtcagggccgagccgagcggatcgctgggcgctgtgcagaggaaaggcgggagtgcccggctcgctgtcgcagagccgaggtgggtaagctagcgaccacctggacttcccagcgcccaaccgtggcttttcagccaggtcctctcctcccgcggcttctcaaccaaccccatcccagcgccggccacccaacctcccgaaatgagtgcttcctgccccagcagccgaaggcgctactaggaacggtaacctgttacttttccaggggccgtagtcgacccgctgcccgagttgctgtgcgactgcgcgcgcggggctagagtgcaaggtgactgtggttcttctctggccaagtccgagggagaacgtaaagatatgggcctttttccccctctcaccttgtctcaccaaagtccctagtccccggagcagttagcctctttctttccagggaattagccagacacaacaacgggaaccagacaccgaaccagacatgcccgccccgtgcgccctccccgctcgctgcctttcctccctcttgtctctccagagccggatcttcaaggggagcctccgtgcccccggctgctcagtccctccggtgtgcaggaccccggaagtcctccccgcacagctctcgcttctctttgcagcctgtttctgcgccggaccagtcgaggactctggacagtagaggccccgggacgaccgagctggaattcgccaccatggccgcggccaaggccgagatgcagctgatgtccccgctgcagatctctgacccgttcggatcctttcctcactcgcccaccatggacaactaccctaagctggaggagatgatgctgctgagcaacggggctccccagttcctcggcgccgccggggccccagagggcagcggcagcaacagcagcagcagcagcagcgggggcggtggaggcggcgggggcggcagcaacagcagcagcagcagcagcaccttcaaccctcaggcggacacgggcgagcagccctacgagcacctgaccgcagagtcttttcctgacatctctctgaacaacgagaaggtgctggtggagaccagttaccccagccaaaccactcgactgccccccatcacctatactggccgcttttccctggagcctgcacccaacagtggcaacaccttgtggcccgagcccctcttcagcttggtcagtggcctagtgagcatgaccaacccaccggcctcctcgtcctcagcaccatctccagcggcctcctccgcctccgcctcccagagcccacccctgagctgcgcagtgccatccaacgacagcagtcccatttactcagcggcacccaccttccccacgccgaacactgacattttccctgagccacaaagccaggccttcccgggctcggcagggacagcgctccagtacccgcctcctgcctaccctgccgccaagggtggcttccaggttcccatgatccccgactacctgtttccacagcagcagggggatctgggcctgggcaccccagaccagaagcccttccagggcctggagagccgcacccagcagccttcgctaacccctctgtctactattaaggcctttgccactcagtcgggctcccaggacctgaaggccctcaataccagctaccagtcccagctcatcaaacccagccgcatgcgcaagtaccccaaccggcccagcaagacgcccccccacgaacgcccttacgcttgcccagtggagtcctgtgatcgccgcttctcccgcagcgacaacctggtgagacacatccgcatccacacaggccagaagcccttccagtgccgcatctgcatgagaaacttcagccgagaggataacttgcacactcacatccgcacccacacaggcgaaaagcccttcgcctgcgacatctgtggaagaaagtttgcccggagcgatgaacttgtccgacacatccggacacacacgggagagaagccattcgcatgtgatatatgtgggagaaagttctcccaatcagggaatctgactgagcacatccgcatccacacaggccagaagcccttccagtgccgcatctgcatgagaaacttcagcacaagtggacatctggtacgccacatccgcacccacacaggcgaaaagcccttcgcctgcgacatctgtggaagaaagtttgcccagaatagtaccctgaccgaacataccaagatccacttgcggcagaaggacaagaaagcagacaaaagtgttgtggctagctcggccacctcctctctctcttcctacccgtccccggttgctacctcttacccgtccccggttactacctcttatccatccccggccaccacctcatacccatcccctgtgcccacctccttctcctctcccggctcctcgacctacccatcccctgtgcacagtggcttcccctccccgtcggtggccaccacgtactcctctgttccccctgctttcccggcccaggtcagcagcttcccttcctcagctgtcaccaactccttcagcgcctccacagggctttcggacatgacagcaaccttttctcccaggacaattgaaatttgctaaactagtaagcttgggtggcatccctgtgacccctccccagtgcctctcctggccctggaagttgccactccagtgcccaccagccttgtcctaataaaattaagttgcatcattttgtctgactaggtgtccttctataatattatggggtggaggggggtggtatggagcaaggggcaagttgggaagacaacctgtagggcctgcggggtctattgggaaccaagctggagtgcagtggcacaatcttggctcactgcaatctccgcctcctgggttcaagcgattctcctgcctcagcctcccgagttgttgggattccaggcatgcatgaccaggctcagctaatttttgtttttttggtagagacggggtttcaccatattggccaggctggtctccaactcctaatctcaggtgatctacccaccttggcctcccaaattgctgggattacaggcgtgaaccactgctcccttccctgtcctt

SEQ ID NO: 364 - protein, 667 aa, Artificial Sequence
  Description of Artificial Sequence: Synthetic polypeptide
MYPYDVPDYAGYPYDVPDYAGSYPYDVPDYAGSGSGSAAAKAEMQLMSPLQISDPFGSFPHSPTMDNYPKLEEMMLLSNGAPQFLGAAGAPEGSGSNSSSSSSGGGGGGGGGSNSSSSSSTFNPQADTGEQPYEHLTAESFPDISLNNEKVLVETSYPSQTTRLPPITYTGRFSLEPAPNSGNTLWPEPLFSLVSGLVSMTNPPASSSSAPSPAASSASASQSPPLSCAVPSNDSSPIYSAAPTFPTPNTDIFPEPQSQAFPGSAGTALQYPPPAYPAAKGGFQVPMIPDYLFPQQQGDLGLGTPDQKPFQGLESRTQQPSLTPLSTIKAFATQSGSQDLKALNTSYQSQLIKPSRMRKYPNRPSKTPPHERPYACPVESCDRRFSRSDNLVRHIRIHTGQKPFQCRICMRNFSHRTTLTNHIRTHTGEKPFACDICGRKFAREDNLHTHTKIHLRQKDRPYACPVESCDRRFSTSHSLTEHIRIHTGQKPFQCRICMRNFSQSSSLVRHIRTHTGEKPFACDICGRKFAREDNLHTHTKIHLRQKDKKADKSVVASSATSSLSSYPSPVATSYPSPVTTSYPSPATTSYPSPVPTSFSSPGSSTYPSPVHSGFPSPSVATTYSSVPPAFPAQVSSFPSSAVTNSFSASTGLSDMTATFSPRTIEIC

SEQ ID NO: 365 - protein, 272 aa, Artificial Sequence; identical to SEQ ID NO: 279
  Description of Artificial Sequence: Synthetic polypeptide

SEQ ID NO: 366 - protein, 753 aa, Artificial Sequence; identical to SEQ ID NO: 309
  Description of Artificial Sequence: Synthetic polypeptide

SEQ ID NO: 367 - DNA, 3803 bp, Artificial Sequence
  Description of Artificial Sequence: Synthetic polynucleotide
gcggccgcacgcgtggcgcgccgtttaaacttaattaagctagccgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttgttgtgctgtctcatcattttggcaaagaattggtaccgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtccggactcagatctcgagaggaggaggaggagacagacagcaggatgccccacctcgacagccccggcagctcccagccgagacgctccttcctctcaagggtgatcagggcagctctaccgttgcagctgcttctgctgctgctgctgctcctggcctgcctgctacctgcctctgaagatgactacagctgcacccaggccaacaactttgcccgatccttctaccccatgctgcggtacaccaacgggccacctcccacctagagcgctaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctatgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcagatctacgggtggcatccctgtgacccctccccagtgcctctcctggccctggaagttgccactccagtgcccaccagccttgtcctaataaaattaagttgcatcattttgtctgactaggtgtccttctataatattatggggtggaggggggtggtatggagcaaggggcaagttgggaagacaacctgtagggcctgcggggtctattgggaaccaagctggagtgcagtggcacaatcttggctcactgcaatctccgcctcctgggttcaagcgattctcctgcctcagcctcccgagttgttgggattccaggcatgcatgaccaggctcagctaatttttgtttttttggtagagacggggtttcaccatattggccaggctggtctccaactcctaatctcaggtgatctacccaccttggcctcccaaattgctgggattacaggcgtgaaccactgctcccttccctgtccttctgattttgtaggtaaccacgtgcggaccgagcggccgc

SEQ ID NO: 368 - DNA, 3803 bp, Artificial Sequence; identical to SEQ ID NO: 367
  Description of Artificial Sequence: Synthetic polynucleotide

SEQ ID NO: 369 - DNA, 20 bp, Artificial Sequence
  Description of Artificial Sequence: Synthetic primer
gctaccccgaccacatgaag

SEQ ID NO: 370 - DNA, 20 bp, Artificial Sequence
  Description of Artificial Sequence: Synthetic primer
tcttgtagttgccgtcgtcc

SEQ ID NO: 371 - protein, 292 aa, Artificial Sequence
  Description of Artificial Sequence: Synthetic polypeptide
  MOD_RES (8)..(57): Any amino acid
  MISC_FEATURE (8)..(57): This region may encompass 1-50 residues
  MOD_RES (65)..(114): Any amino acid
  MISC_FEATURE (65)..(114): This region may encompass 1-50 residues
  MOD_RES (122)..(171): Any amino acid
  MISC_FEATURE (122)..(171): This region may encompass 1-50 residues
  MOD_RES (179)..(228): Any amino acid
  MISC_FEATURE (179)..(228): This region may encompass 1-50 residues
  MOD_RES (236)..(285): Any amino acid
  MISC_FEATURE (236)..(285): This region may encompass 1-50 residues
RSDNLVRXXXXXXXXXXXXXXXXXXXXXXXXXXXXXXXXXXXXXXXXXXXXXXXXXXHRTTLTNXXXXXXXXXXXXXXXXXXXXXXXXXXXXXXXXXXXXXXXXXXXXXXXXXXREDNLHTXXXXXXXXXXXXXXXXXXXXXXXXXXXXXXXXXXXXXXXXXXXXXXXXXXTSHSLTEXXXXXXXXXXXXXXXXXXXXXXXXXXXXXXXXXXXXXXXXXXXXXXXXXXQSSSLVRXXXXXXXXXXXXXXXXXXXXXXXXXXXXXXXXXXXXXXXXXXXXXXXXXXREDNLHT

SEQ ID NO: 372 - protein, 463 aa, Artificial Sequence
  Description of Artificial Sequence: Synthetic polypeptide
  MOD_RES (8)..(57): Any amino acid
  MISC_FEATURE (8)..(57): This region may encompass 1-50 residues
  MOD_RES (65)..(114): Any amino acid
  MISC_FEATURE (65)..(114): This region may encompass 1-50 residues
  MOD_RES (122)..(171): Any amino acid
  MISC_FEATURE (122)..(171): This region may encompass 1-50 residues
  MOD_RES (179)..(228): Any amino acid
  MISC_FEATURE (179)..(228): This region may encompass 1-50 residues
  MOD_RES (236)..(285): Any amino acid
  MISC_FEATURE (236)..(285): This region may encompass 1-50 residues
  MOD_RES (293)..(342): Any amino acid
  MISC_FEATURE (293)..(342): This region may encompass 1-50 residues
  MOD_RES (350)..(399): Any amino acid
  MISC_FEATURE (350)..(399): This region may encompass 1-50 residues
  MOD_RES (407)..(456): Any amino acid
  MISC_FEATURE (407)..(456): This region may encompass 1-50 residues
RRDELNVXXXXXXXXXXXXXXXXXXXXXXXXXXXXXXXXXXXXXXXXXXXXXXXXXXRSDHLTNXXXXXXXXXXXXXXXXXXXXXXXXXXXXXXXXXXXXXXXXXXXXXXXXXXRSDDLVRXXXXXXXXXXXXXXXXXXXXXXXXXXXXXXXXXXXXXXXXXXXXXXXXXXRSDNLVRXXXXXXXXXXXXXXXXXXXXXXXXXXXXXXXXXXXXXXXXXXXXXXXXXXHRTTLTNXXXXXXXXXXXXXXXXXXXXXXXXXXXXXXXXXXXXXXXXXXXXXXXXXXREDNLHTXXXXXXXXXXXXXXXXXXXXXXXXXXXXXXXXXXXXXXXXXXXXXXXXXXTSHSLTEXXXXXXXXXXXXXXXXXXXXXXXXXXXXXXXXXXXXXXXXXXXXXXXXXXQSSSLVRXXXXXXXXXXXXXXXXXXXXXXXXXXXXXXXXXXXXXXXXXXXXXXXXXXREDNLHT

SEQ ID NO: 373 - DNA, 9 bp, Artificial Sequence
  Description of Artificial Sequence: Synthetic oligonucleotide
gcgkgggcg

SEQ ID NO: 374 - DNA, 20 bp, Artificial Sequence
  Description of Artificial Sequence: Synthetic primer
caaaaaagccacaaaagcct

SEQ ID NO: 375 - DNA, 20 bp, Artificial Sequence
  Description of Artificial Sequence: Synthetic primer
ttagctccgcaagaaacatc

SEQ ID NO: 376 - protein, 292 aa, Artificial Sequence
  Description of Artificial Sequence: Synthetic polypeptide
  MOD_RES (8)..(57): Any amino acid
  MISC_FEATURE (8)..(57): This region may encompass 1-50 residues
  MOD_RES (65)..(114): Any amino acid
  MISC_FEATURE (65)..(114): This region may encompass 1-50 residues
  MOD_RES (122)..(171): Any amino acid
  MISC_FEATURE (122)..(171): This region may encompass 1-50 residues
  MOD_RES (179)..(228): Any amino acid
  MISC_FEATURE (179)..(228): This region may encompass 1-50 residues
  MOD_RES (236)..(285): Any amino acid
  MISC_FEATURE (236)..(285): This region may encompass 1-50 residues
DPGALVRXXXXXXXXXXXXXXXXXXXXXXXXXXXXXXXXXXXXXXXXXXXXXXXXXXRSDNLVRXXXXXXXXXXXXXXXXXXXXXXXXXXXXXXXXXXXXXXXXXXXXXXXXXXQSGDLRRXXXXXXXXXXXXXXXXXXXXXXXXXXXXXXXXXXXXXXXXXXXXXXXXXXTHLDLIRXXXXXXXXXXXXXXXXXXXXXXXXXXXXXXXXXXXXXXXXXXXXXXXXXXTSGNLVRXXXXXXXXXXXXXXXXXXXXXXXXXXXXXXXXXXXXXXXXXXXXXXXXXXRSDNLVR

SEQ ID NO: 377 - protein, 176 aa, Artificial Sequence
  Description of Artificial Sequence: Synthetic polypeptide
LEPGEKPYKCPECGKSFSTSHSLTEHQRTHTGEKPYKCPECGKSFSDCRDLARHQRTHTGEKPYKCPECGKSFSTTGNLTVHQRTHTGEKPYKCPECGKSFSDPGALVRHQRTHTGEKPYKCPECGKSFSTHLDLIRHQRTHTGEKPYKCPECGKSFSHTGHLLEHQRTHTGKKTS

SEQ ID NO: 378 - protein, 192 aa, Artificial Sequence
  Description of Artificial Sequence: Synthetic polypeptide
LEPGEKPYKCPECGKSFSRNDTLTEHQRTHTGEKPYKCPECGKSFSDPGALVRHQRTHTGEKPYKCPECGKSFSTSGELVRHQRTHTGEKPYKCPECGKSFSRSDNLVRHQRTHTGEKPYKCPECGKSFSTSGELVRHQRTHTGEKPYKCPECGKSFSTKNSLTEHQRTHTGKKTSKRPAATKKAGQAKKKK

SEQ ID NO: 379 - protein, 204 aa, Artificial Sequence
  Description of Artificial Sequence: Synthetic polypeptide
LEPGEKPYKCPECGKSFSTSGNLTEHQRTHTGEKPYKCPECGKSFSRADNLTEHQRTHTGEKPYKCPECGKSFSSPADLTRHQRTHTGEKPYKCPECGKSFSQSSNLVRHQRTHTGEKPYKCPECGKSFSQRANLRAHQRTHTGEKPYKCPECGKSFSQLAHLRAHQRTHTGEKPYKCPECGKSFSHRTTLTNHQRTHTGKKTS

SEQ ID NO: 380 - protein, 176 aa, Artificial Sequence; identical to SEQ ID NO: 168
  Description of Artificial Sequence: Synthetic polypeptide

SEQ ID NO: 381 - protein, 176 aa, Artificial Sequence; identical to SEQ ID NO: 168
  Description of Artificial Sequence: Synthetic polypeptide

SEQ ID NO: 382 - protein, 176 aa, Artificial Sequence; identical to SEQ ID NO: 168
  Description of Artificial Sequence: Synthetic polypeptide

SEQ ID NO: 383 - protein, 176 aa, Artificial Sequence; identical to SEQ ID NO: 168
  Description of Artificial Sequence: Synthetic polypeptide

SEQ ID NO: 384 - protein, 260 aa, Artificial Sequence; identical to SEQ ID NO: 169
  Description of Artificial Sequence: Synthetic polypeptide

SEQ ID NO: 385 - protein, 190 aa, Artificial Sequence
  Description of Artificial Sequence: Synthetic polypeptide
RKYPNRPSKTPPHERPYACPVESCDRRFSSPADLTRHIRIHTGQKPFQCRICMRNFSDSGNLRVHIRTHTGEKPFACDICGRKFAQLAHLRAHTKIHLRQKDRPYACPVESCDRRFSQRANLRAHIRIHTGQKPFQCRICMRNFSREDNLHTHIRTHTGEKPFACDICGRKFARSDNLVRHTKIHLRQKD

SEQ ID NO: 386 - protein, 191 aa, Artificial Sequence
  Description of Artificial Sequence: Synthetic polypeptide
RKYPNRPSKTPPHERPYACPVESCDRRFSSPADLTRHIRIHTGQKPFQCRICMRNFSDSGNLRVHIRTHTGEKPFACDICGRKFAQLAHLRAHTKIHLRQKDRPYACPVESCDRRFSQRANLRAHIRIHTGQKPFQCRICMRNFSREDNLHTHIRTHTGEKPFACDICGRKFARSDNLVRHTKIHLRQKDK

SEQ ID NO: 387 - protein, 172 aa, Artificial Sequence; identical to SEQ ID NO: 93
  Description of Artificial Sequence: Synthetic polypeptide

SEQ ID NO: 388 - protein, 172 aa, Artificial Sequence; identical to SEQ ID NO: 93
  Description of Artificial Sequence: Synthetic polypeptide

SEQ ID NO: 389 - protein, 172 aa, Artificial Sequence; identical to SEQ ID NO: 93
  Description of Artificial Sequence: Synthetic polypeptide

SEQ ID NO: 390 - protein, 184 aa, Artificial Sequence; identical to SEQ ID NO: 97
  Description of Artificial Sequence: Synthetic polypeptide

SEQ ID NO: 391 - protein, 204 aa, Artificial Sequence
  Description of Artificial Sequence: Synthetic polypeptide
LEPGEKPYKCPECGKSFSDPGHLVRHQRTHTGEKPYKCPECGKSFSTKNSLTEHQRTHTGEKPYKCPECGKSFSRNDALTEHQRTHTGEKPYKCPECGKSFSERSHLREHQRTHTGEKPYKCPECGKSFSSKKHLAEHQRTHTGEKPYKCPECGKSFSTHLDLIRHQRTHTGEKPYKCPECGKSFSQSGNLTEHQRTHTGKKTS

SEQ ID NO: 392 - protein, 176 aa, Artificial Sequence
  Description of Artificial Sequence: Synthetic polypeptide
LEPGEKPYKCPECGKSFSSRRTCRAHQRTHTGEKPYKCPECGKSFSTTGALTEHQRTHTGEKPYKCPECGKSFSRSDELVRHQRTHTGEKPYKCPECGKSFSRNDALTEHQRTHTGEKPYKCPECGKSFSQSGDLRRHQRTHTGEKPYKCPECGKSFSTSHSLTEHQRTHTGKKTS

SEQ ID NO: 393 - protein, 176 aa, Artificial Sequence
  Description of Artificial Sequence: Synthetic polypeptide
LEPGEKPYKCPECGKSFSRKDNLKNHQRTHTGEKPYKCPECGKSFSDPGALVRHQRTHTGEKPYKCPECGKSFSREDNLHTHQRTHTGEKPYKCPECGKSFSDPGALVRHQRTHTGEKPYKCPECGKSFSTSGELVRHQRTHTGEKPYKCPECGKSFSRKDNLKNHQRTHTGKKTS

SEQ ID NO: 394 - protein, 176 aa, Artificial Sequence; identical to SEQ ID NO: 131
  Description of Artificial Sequence: Synthetic polypeptide

SEQ ID NO: 395 - protein, 232 aa, Artificial Sequence
  Description of Artificial Sequence: Synthetic polypeptide
LEPGEKPYKCPECGKSFSSKKALTEHQRTHTGEKPYKCPECGKSFSSPADLTRHQRTHTGEKPYKCPECGKSFSRSDNLVRHQRTHTGEKPYKCPECGKSFSREDNLHTHQRTHTGEKPYKCPECGKSFSRSDELVRHQRTHTGEKPYKCPECGKSFSQSGNLTEHQRTHTGEKPYKCPECGKSFSTSGHLVRHQRTHTGEKPYKCPECGKSFSQNSTLTEHQRTHTGKKTS

SEQ ID NO: 396 - protein, 176 aa, Artificial Sequence
  Description of Artificial Sequence: Synthetic polypeptide
LEPGEKPYKCPECGKSFSSPADLTRHQRTHTGEKPYKCPECGKSFSRSDNLVRHQRTHTGEKPYKCPECGKSFSREDNLHTHQRTHTGEKPYKCPECGKSFSRSDELVRHQRTHTGEKPYKCPECGKSFSQSGNLTEHQRTHTGEKPYKCPECGKSFSTSGHLVRHQRTHTGKKTS

SEQ ID NO: 397 - protein, 176 aa, Artificial Sequence
  Description of Artificial Sequence: Synthetic polypeptide
LEPGEKPYKCPECGKSFSSKKALTEHQRTHTGEKPYKCPECGKSFSSPADLTRHQRTHTGEKPYKCPECGKSFSRSDNLVRHQRTHTGEKPYKCPECGKSFSREDNLHTHQRTHTGEKPYKCPECGKSFSRSDELVRHQRTHTGEKPYKCPECGKSFSQSGNLTEHQRTHTGKKTS

SEQ ID NO: 398 - protein, 232 aa, Artificial Sequence
  Description of Artificial Sequence: Synthetic polypeptide
LEPGEKPYKCPECGKSFSDCRDLARHQRTHTGEKPYKCPECGKSFSRNDALTEHQRTHTGEKPYKCPECGKSFSRNDALTEHQRTHTGEKPYKCPECGKSFSSPADLTRHQRTHTGEKPYKCPECGKSFSDPGNLVRHQRTHTGEKPYKCPECGKSFSQRAHLERHQRTHTGEKPYKCPECGKSFSQSSSLVRHQRTHTGEKPYKCPECGKSFSHRTTLTNHQRTHTGKKTS

SEQ ID NO: 399 - protein, 176 aa, Artificial Sequence
  Description of Artificial Sequence: Synthetic polypeptide
LEPGEKPYKCPECGKSFSRNDALTEHQRTHTGEKPYKCPECGKSFSSPADLTRHQRTHTGEKPYKCPECGKSFSDPGNLVRHQRTHTGEKPYKCPECGKSFSQRAHLERHQRTHTGEKPYKCPECGKSFSQSSSLVRHQRTHTGEKPYKCPECGKSFSHRTTLTNHQRTHTGKKTS

SEQ ID NO: 400 - protein, 176 aa, Artificial Sequence
  Description of Artificial Sequence: Synthetic polypeptide
LEPGEKPYKCPECGKSFSTKNSLTEHQRTHTGEKPYKCPECGKSFSRADNLTEHQRTHTGEKPYKCPECGKSFSQLAHLRAHQRTHTGEKPYKCPECGKSFSTKNSLTEHQRTHTGEKPYKCPECGKSFSQAGHLASHQRTHTGEKPYKCPECGKSFSTHLDLIRHQRTHTGKKTS

SEQ ID NO: 401 - protein, 204 aa, Artificial Sequence
  Description of Artificial Sequence: Synthetic polypeptide
LEPGEKPYKCPECGKSFSRNDALTEHQRTHTGEKPYKCPECGKSFSDPGHLVRHQRTHTGEKPYKCPECGKSFSTSGELVRHQRTHTGEKPYKCPECGKSFSTHLDLIRHQRTHTGEKPYKCPECGKSFSSKKALTEHQRTHTGEKPYKCPECGKSFSQLAHLRAHQRTHTGEKPYKCPECGKSFSRSDHLTNHQRTHTGKKTS

SEQ ID NO: 402 - protein, 176 aa, Artificial Sequence; identical to SEQ ID NO: 132
  Description of Artificial Sequence: Synthetic polypeptide

SEQ ID NO: 403 - protein, 176 aa, Artificial Sequence; identical to SEQ ID NO: 133
  Description of Artificial Sequence: Synthetic polypeptide

SEQ ID NO: 404 - protein, 176 aa, Artificial Sequence
  Description of Artificial Sequence: Synthetic polypeptide
LEPGEKPYKCPECGKSFSQAGHLASHQRTHTGEKPYKCPECGKSFSREDNLHTHQRTHTGEKPYKCPECGKSFSTSGNLTEHQRTHTGEKPYKCPECGKSFSTHLDLIRHQRTHTGEKPYKCPECGKSFSQKSSLIAHQRTHTGEKPYKCPECGKSFSQAGHLASHQRTHTGKKTS

SEQ ID NO: 405 - protein, 176 aa, Artificial Sequence
  Description of Artificial Sequence: Synthetic polypeptide
LEPGEKPYKCPECGKSFSTTGNLTVHQRTHTGEKPYKCPECGKSFSTSGELVRHQRTHTGEKPYKCPECGKSFSREDNLHTHQRTHTGEKPYKCPECGKSFSTSGNLTEHQRTHTGEKPYKCPECGKSFSQSSSLVRHQRTHTGEKPYKCPECGKSFSQRANLRAHQRTHTGKKTS

SEQ ID NO: 406 - protein, 198 aa, Artificial Sequence
  Description of Artificial Sequence: Synthetic polypeptide
RKYPNRPSKTPPHERPYACPVESCDRRFSRSDNLVRHIRIHTGQKPFQCRICMRNFSHRTTLTNHIRTHTGEKPFACDICGRKFAREDNLHTHTKIHLRQKDRPYACPVESCDRRFSTSHSLTEHIRIHTGQKPFQCRICMRNFSQSSSLVRHIRTHTGEKPFACDICGRKFAREDNLHTHTKIHLRQKDKKADKSVV

SEQ ID NO: 407 - protein, 630 aa, Artificial Sequence
  Description of Artificial Sequence: Synthetic polypeptide
AAAKAEMQLMSPLQISDPFGSFPHSPTMDNYPKLEEMMLLSNGAPQFLGAAGAPEGSGSNSSSSSSGGGGGGGGGSNSSSSSSTFNPQADTGEQPYEHLTAESFPDISLNNEKVLVETSYPSQTTRLPPITYTGRFSLEPAPNSGNTLWPEPLFSLVSGLVSMTNPPASSSSAPSPAASSASASQSPPLSCAVPSNDSSPIYSAAPTFPTPNTDIFPEPQSQAFPGSAGTALQYPPPAYPAAKGGFQVPMIPDYLFPQQQGDLGLGTPDQKPFQGLESRTQQPSLTPLSTIKAFATQSGSQDLKALNTSYQSQLIKPSRMRKYPNRPSKTPPHERPYACPVESCDRRFSRSDNLVRHIRIHTGQKPFQCRICMRNFSREDNLHTHIRTHTGEKPFACDICGRKFARSDELVRHTKIHLRQKDRPYACPVESCDRRFSQSGNLTEHIRIHTGQKPFQCRICMRNFSTSGHLVRHIRTHTGEKPFACDICGRKFAQNSTLTEHTKIHLRQKDKKADKSVVASSATSSLSSYPSPVATSYPSPVTTSYPSPATTSYPSPVPTSFSSPGSSTYPSPVHSGFPSPSVATTYSSVPPAFPAQVSSFPSSAVTNSFSASTGLSDMTATFSPRTIEIC

SEQ ID NO: 408 - protein, 264 aa, Artificial Sequence
  Description of Artificial Sequence: Synthetic polypeptide
RPYACPVESCDRRFSDPGALVRHIRIHTGQKPFQCRICMRNFSRSDNLVRHIRTHTGEKPFACDICGRKFAQSGDLRRHTKIHLRQKDRPYACPVESCDRRFSTHLDLIRHIRIHTGQKPFQCRICMRNFSTSGNLVRHIRTHTGEKPFACDICGRKFARSDNLVRHTKIHLRQKDRPYACPVESCDRRFSQSGHLTEHIRIHTGQKPFQCRICMRNFSERSHLREHIRTHTGEKPFACDICGRKFAQAGHLASHTKIHLRQKD

SEQ ID NO: 409 - protein, 194 aa, Artificial Sequence
  Description of Artificial Sequence: Synthetic polypeptide
RKYPNRPSKTPPHERPYACPVESCDRRFSRSDNLVRHIRIHTGQKPFQCRICMRNFSREDNLHTHIRTHTGEKPFACDICGRKFARSDELVRHIRTHTGEKPFACDICGRKFSQSGNLTEHIRIHTGQKPFQCRICMRNFSTSGHLVRHIRTHTGEKPFACDICGRKFAQNSTLTEHTKIHLRQKDKKADKSVV

SEQ ID NO: 410 - protein, 8 aa, Artificial Sequence
  Description of Artificial Sequence: Synthetic peptide
GGSGGGSG

SEQ ID NO: 411 - skipped

SEQ ID NO: 412 - protein, 292 aa, Artificial Sequence
  Description of Artificial Sequence: Synthetic polypeptide
  MOD_RES (8)..(57): Any amino acid
  MISC_FEATURE (8)..(57): This region may encompass 1-50 residues
  MOD_RES (65)..(114): Any amino acid
  MISC_FEATURE (65)..(114): This region may encompass 1-50 residues
  MOD_RES (122)..(171): Any amino acid
  MISC_FEATURE (122)..(171): This region may encompass 1-50 residues
  MOD_RES (179)..(228): Any amino acid
  MISC_FEATURE (179)..(228): This region may encompass 1-50 residues
  MOD_RES (236)..(285): Any amino acid
  MISC_FEATURE (236)..(285): This region may encompass 1-50 residues
RSDNLVRXXXXXXXXXXXXXXXXXXXXXXXXXXXXXXXXXXXXXXXXXXXXXXXXXXDPGHLVRXXXXXXXXXXXXXXXXXXXXXXXXXXXXXXXXXXXXXXXXXXXXXXXXXXRSDHLTTXXXXXXXXXXXXXXXXXXXXXXXXXXXXXXXXXXXXXXXXXXXXXXXXXXRSDELVRXXXXXXXXXXXXXXXXXXXXXXXXXXXXXXXXXXXXXXXXXXXXXXXXXXRSDKLVRXXXXXXXXXXXXXXXXXXXXXXXXXXXXXXXXXXXXXXXXXXXXXXXXXXTTGNLTV

SEQ ID NO: 413 - protein, 292 aa, Artificial Sequence
  Description of Artificial Sequence: Synthetic polypeptide
  MOD_RES (8)..(57): Any amino acid
  MISC_FEATURE (8)..(57): This region may encompass 1-50 residues
  MOD_RES (65)..(114): Any amino acid
  MISC_FEATURE (65)..(114): This region may encompass 1-50 residues
  MOD_RES (122)..(171): Any amino acid
  MISC_FEATURE (122)..(171): This region may encompass 1-50 residues
  MOD_RES (179)..(228): Any amino acid
  MISC_FEATURE (179)..(228): This region may encompass 1-50 residues
  MOD_RES (236)..(285): Any amino acid
  MISC_FEATURE (236)..(285): This region may encompass 1-50 residues
RSDHLTTXXXXXXXXXXXXXXXXXXXXXXXXXXXXXXXXXXXXXXXXXXXXXXXXXXRSDELVRXXXXXXXXXXXXXXXXXXXXXXXXXXXXXXXXXXXXXXXXXXXXXXXXXXRSDKLVRXXXXXXXXXXXXXXXXXXXXXXXXXXXXXXXXXXXXXXXXXXXXXXXXXXTTGNLTVXXXXXXXXXXXXXXXXXXXXXXXXXXXXXXXXXXXXXXXXXXXXXXXXXXQLAHLRAXXXXXXXXXXXXXXXXXXXXXXXXXXXXXXXXXXXXXXXXXXXXXXXXXXTKNSLTE

SEQ ID NO: 414 - protein, 292 aa, Artificial Sequence
  Description of Artificial Sequence: Synthetic polypeptide
  MOD_RES (8)..(57): Any amino acid
  MISC_FEATURE (8)..(57): This region may encompass 1-50 residues
  MOD_RES (65)..(114): Any amino acid
  MISC_FEATURE (65)..(114): This region may encompass 1-50 residues
  MOD_RES (122)..(171): Any amino acid
  MISC_FEATURE (122)..(171): This region may encompass 1-50 residues
  MOD_RES (179)..(228): Any amino acid
  MISC_FEATURE (179)..(228): This region may encompass 1-50 residues
  MOD_RES (236)..(285): Any amino acid
  MISC_FEATURE (236)..(285): This region may encompass 1-50 residues
SPADLTRXXXXXXXXXXXXXXXXXXXXXXXXXXXXXXXXXXXXXXXXXXXXXXXXXXDSGNLRVXXXXXXXXXXXXXXXXXXXXXXXXXXXXXXXXXXXXXXXXXXXXXXXXXXQLAHLRAXXXXXXXXXXXXXXXXXXXXXXXXXXXXXXXXXXXXXXXXXXXXXXXXXXQRANLRAXXXXXXXXXXXXXXXXXXXXXXXXXXXXXXXXXXXXXXXXXXXXXXXXXXREDNLHTXXXXXXXXXXXXXXXXXXXXXXXXXXXXXXXXXXXXXXXXXXXXXXXXXXRSDNLVR

SEQ ID NO: 415 - protein, 463 aa, Artificial Sequence
  Description of Artificial Sequence: Synthetic polypeptide
  MOD_RES (8)..(57): Any amino acid
  MISC_FEATURE (8)..(57): This region may encompass 1-50 residues
  MOD_RES (65)..(114): Any amino acid
  MISC_FEATURE (65)..(114): This region may encompass 1-50 residues
  MOD_RES (122)..(171): Any amino acid
  MISC_FEATURE (122)..(171): This region may encompass 1-50 residues
  MOD_RES (179)..(228): Any amino acid
  MISC_FEATURE (179)..(228): This region may encompass 1-50 residues
  MOD_RES (236)..(285): Any amino acid
  MISC_FEATURE (236)..(285): This region may encompass 1-50 residues
  MOD_RES (293)..(342): Any amino acid
  MISC_FEATURE (293)..(342): This region may encompass 1-50 residues
  MOD_RES (350)..(399): Any amino acid
  MISC_FEATURE (350)..(399): This region may encompass 1-50 residues
  MOD_RES (407)..(456): Any amino acid
  MISC_FEATURE (407)..(456): This region may encompass 1-50 residues
TSHSLTEXXXXXXXXXXXXXXXXXXXXXXXXXXXXXXXXXXXXXXXXXXXXXXXXXXHKNALQNXXXXXXXXXXXXXXXXXXXXXXXXXXXXXXXXXXXXXXXXXXXXXXXXXXERSHLREXXXXXXXXXXXXXXXXXXXXXXXXXXXXXXXXXXXXXXXXXXXXXXXXXXSKKALTEXXXXXXXXXXXXXXXXXXXXXXXXXXXXXXXXXXXXXXXXXXXXXXXXXXQRANLRAXXXXXXXXXXXXXXXXXXXXXXXXXXXXXXXXXXXXXXXXXXXXXXXXXXRKDNLKNXXXXXXXXXXXXXXXXXXXXXXXXXXXXXXXXXXXXXXXXXXXXXXXXXXQSSNLVRXXXXXXXXXXXXXXXXXXXXXXXXXXXXXXXXXXXXXXXXXXXXXXXXXXQSSSLVRXXXXXXXXXXXXXXXXXXXXXXXXXXXXXXXXXXXXXXXXXXXXXXXXXXQAGHLAS

SEQ ID NO: 416 - protein, 349 aa, Artificial Sequence
  Description of Artificial Sequence: Synthetic polypeptide
  MOD_RES (8)..(57): Any amino acid
  MISC_FEATURE (8)..(57): This region may encompass 1-50 residues
  MOD_RES (65)..(114): Any amino acid
  MISC_FEATURE (65)..(114): This region may encompass 1-50 residues
  MOD_RES (122)..(171): Any amino acid
  MISC_FEATURE (122)..(171): This region may encompass 1-50 residues
  MOD_RES (179)..(228): Any amino acid
  MISC_FEATURE (179)..(228): This region may encompass 1-50 residues
  MOD_RES (236)..(285): Any amino acid
  MISC_FEATURE (236)..(285): This region may encompass 1-50 residues
  MOD_RES (293)..(342): Any amino acid
  MISC_FEATURE (293)..(342): This region may encompass 1-50 residues
QSGDLRRXXXXXXXXXXXXXXXXXXXXXXXXXXXXXXXXXXXXXXXXXXXXXXXXXXSPADLTRXXXXXXXXXXXXXXXXXXXXXXXXXXXXXXXXXXXXXXXXXXXXXXXXXXDSGNLRVXXXXXXXXXXXXXXXXXXXXXXXXXXXXXXXXXXXXXXXXXXXXXXXXXXQLAHLRAXXXXXXXXXXXXXXXXXXXXXXXXXXXXXXXXXXXXXXXXXXXXXXXXXXQRANLRAXXXXXXXXXXXXXXXXXXXXXXXXXXXXXXXXXXXXXXXXXXXXXXXXXXREDNLHTXXXXXXXXXXXXXXXXXXXXXXXXXXXXXXXXXXXXXXXXXXXXXXXXXXRSDNLVR

SEQ ID NO: 417 - DNA, 509 bp, Artificial Sequence
  Description of Artificial Sequence: Synthetic polynucleotide
gccctctaggccacctgaccaggtcccctcagtcccccccttcccacactcccacactcagcccccctcccccccccccgacccctgcaggattatcctgtctgtgttcctgactcagcctgggagccacctgggcagcaggggccaagggtgtcctagaagggacctggagtccacgctgggccaagcctgccctttctccctctgtcttccgtccctgcttgcggttctgctgaatgtggttatttctctggctccttttacagagaatgctgctgctaattttatgtggagctctgaggcagtgtaattggaagccagacaccctgtcagcagtgggctcccgtcctgagctgccatgcttcctgctctcctcccgtcccggctcctcatttcatgcagccacctgtcccagggagagaggagtcacccaggcccctcagtccgccccttaaataagaaagcctccgttgctcggcacacataccaagcagccgctggtgcaatct

SEQ ID NO: 418 - DNA, 990 bp, Artificial Sequence
  Description of Artificial Sequence: Synthetic polynucleotide
gccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtccggactcagatctcgagaggaggaggaggagacagacagcaggatgccccacctcgacagccccggcagctcccagccgagacgctccttcctctcaagggtgatcagggcagctctaccgttgcagctgcttctgctgctgctgctgctcctggcctgcctgctacctgcctctgaagatgactacagctgcacccaggccaacaactttgcccgatccttctaccccatgctgcggtacaccaacgggccacctcccacctag

SEQ ID NO: 419-420 - skipped (2 entries)

SEQ ID NO: 421 - protein, 360 aa, Artificial Sequence
  Description of Artificial Sequence: Synthetic polypeptide
  MOD_RES (19)..(19): Any amino acid
  MOD_RES (41)..(41): Any amino acid
  MOD_RES (63)..(63): Any amino acid
  MOD_RES (85)..(85): Any amino acid
  MOD_RES (107)..(107): Any amino acid
  MOD_RES (129)..(129): Any amino acid
  MOD_RES (151)..(151): Any amino acid
  MOD_RES (173)..(173): Any amino acid
  MOD_RES (195)..(195): Any amino acid
  MOD_RES (217)..(217): Any amino acid
  MOD_RES (239)..(239): Any amino acid
  MOD_RES (261)..(261): Any amino acid
  MOD_RES (283)..(283): Any amino acid
  MOD_RES (305)..(305): Any amino acid
  MOD_RES (327)..(327): Any amino acid
  MISC_FEATURE (8)..(337): This region may encompass 1-15 'Tyr Lys Cys Pro Glu Cys Gly Lys Ser Phe Ser Xaa His Gln Arg Thr His Thr Gly Glu Lys Pro' repeating units
  MOD_RES (349)..(349): Any amino acid
  See specification as filed for detailed description of substitutions and preferred embodiments
LEPGEKPYKCPECGKSFSXHQRTHTGEKPYKCPECGKSFSXHQRTHTGEKPYKCPECGKSFSXHQRTHTGEKPYKCPECGKSFSXHQRTHTGEKPYKCPECGKSFSXHQRTHTGEKPYKCPECGKSFSXHQRTHTGEKPYKCPECGKSFSXHQRTHTGEKPYKCPECGKSFSXHQRTHTGEKPYKCPECGKSFSXHQRTHTGEKPYKCPECGKSFSXHQRTHTGEKPYKCPECGKSFSXHQRTHTGEKPYKCPECGKSFSXHQRTHTGEKPYKCPECGKSFSXHQRTHTGEKPYKCPECGKSFSXHQRTHTGEKPYKCPECGKSFSXHQRTHTGEKPYKCPECGKSFSXHQRTHTGKKTS

SEQ ID NO: 422 - protein, 387 aa, Artificial Sequence
  Description of Artificial Sequence: Synthetic polypeptide
MTGKLAEKLPVTMSSLLNQLPDNLYPEEIPSALNLFSGSSDSVVHYNQMATENVMDIGLTNEKPNPELSYSGSFQPAPGNKTVTYLGKFAFDSPSNWCQDNIISLMSAGILGVPPASGALSTQTSTASMVQPPQGDVEAMYPALPPYSNCGDLYSEPVSFHDPQGNPGLAYSPQDYQSAKPALDSNLFPMIPDYNLYHHPNDMGSIPEHKPFQGMDPIRVNPPPITPLETIKAFKDKQIHPGFGSLPQPPLTLKPIRPRKYPNRPSKTPLHERPHACPAEGCDRRFSRSDELTRHLRIHTGHKPFQCRICMRSFSRSDHLTTHIRTHTGEKPFACEFCGRKFARSDERKRHAKIHLKQKEKKAEKGGAPSASSAPPVSLAPVVTTCA

SEQ ID NO: 423 - protein, 176 aa, Artificial Sequence; identical to SEQ ID NO: 131
  Description of Artificial Sequence: Synthetic polypeptide

SEQ ID NO: 424 - protein, 176 aa, Artificial Sequence; identical to SEQ ID NO: 131
  Description of Artificial Sequence: Synthetic polypeptide

SEQ ID NO: 425 - protein, 176 aa, Artificial Sequence; identical to SEQ ID NO: 131
  Description of Artificial Sequence: Synthetic polypeptide

SEQ ID NO: 426 - protein, 176 aa, Artificial Sequence; identical to SEQ ID NO: 132
  Description of Artificial Sequence: Synthetic polypeptide

SEQ ID NO: 427 - protein, 198 aa, Artificial Sequence
  Description of Artificial Sequence: Synthetic polypeptide
RKYPNRPSKTPPHERPYACPVESCDRRFSRSDNLVRHIRIHTGQKPFQCRICMRNFSREDNLHTHIRTHTGEKPFACDICGRKFARSDELVRHTKIHLRQKDRPYACPVESCDRRFSQSGNLTEHIRIHTGQKPFQCRICMRNFSTSGHLVRHIRTHTGEKPFACDICGRKFAQNSTLTEHTKIHLRQKDKKADKSVV

SEQ ID NO: 428 - protein, 198 aa, Artificial Sequence; identical to SEQ ID NO: 427
  Description of Artificial Sequence: Synthetic polypeptide

SEQ ID NO: 429 - protein, 191 aa, Artificial Sequence
  Description of Artificial Sequence: Synthetic polypeptide
RKYPNRPSKTPPHERPYACPVESCDRRFSRSDNLVRHIRIHTGQKPFQCRICMRNFSREDNLHTHIRTHTGEKPFACDICGRKFARSDELVRHTKIHLRQKDRPYACPVESCDRRFSQSGNLTEHIRIHTGQKPFQCRICMRNFSTSGHLVRHIRTHTGEKPFACDICGRKFAQNSTLTEHTKIHLRQKDK

SEQ ID NO: 430 - protein, 191 aa, Artificial Sequence; identical to SEQ ID NO: 429
  Description of Artificial Sequence: Synthetic polypeptide

SEQ ID NO: 431 - protein, 194 aa, Artificial Sequence; identical to SEQ ID NO: 351
  Description of Artificial Sequence: Synthetic polypeptide

SEQ ID NO: 432 - protein, 201 aa, Artificial Sequence; identical to SEQ ID NO: 90
  Description of Artificial Sequence: Synthetic polypeptide

SEQ ID NO: 433 - protein, 195 aa, Artificial Sequence
  Description of Artificial Sequence: Synthetic polypeptide
QSQLIKPSRMRKYPNRPSKTPPHERPYACPVESCDRRFSRSDNLVRHIRIHTGQKPFQCRICMRNFSHRTTLTNHIRTHTGEKPFACDICGRKFAREDNLHTHTKIHLRQKDRPYACPVESCDRRFSTSHSLTEHIRIHTGQKPFQCRICMRNFSQSSSLVRHIRTHTGEKPFACDICGRKFAREDNLHTHTKIH

SEQ ID NO: 434 - protein, 201 aa, Artificial Sequence; identical to SEQ ID NO: 90
  Description of Artificial Sequence: Synthetic polypeptide

SEQ ID NO: 435 - protein, 194 aa, Artificial Sequence; identical to SEQ ID NO: 351
  Description of Artificial Sequence: Synthetic polypeptide

SEQ ID NO: 436 - protein, 4 aa, Artificial Sequence
  Description of Artificial Sequence: Synthetic peptide
GGGS

SEQ ID NO: 437 - protein, 5 aa, Artificial Sequence
  Description of Artificial Sequence: Synthetic peptide
GGGGS

SEQ ID NO: 438 - protein, 4 aa, Artificial Sequence
  Description of Artificial Sequence: Synthetic peptide
GGSG

SEQ ID NO: 439 - DNA, 21 bp, Artificial Sequence
  Description of Artificial Sequence: Synthetic primer
attggtgggaggccactgtat

SEQ ID NO: 440 - protein, 627 aa, Artificial Sequence; identical to SEQ ID NO: 299
  Description of Artificial Sequence: Synthetic polypeptide

SEQ ID NO: 441 - protein, 194 aa, Artificial Sequence; identical to SEQ ID NO: 409
  Description of Artificial Sequence: Synthetic polypeptide

SEQ ID NO: 442 - DNA, 2259 bp, Artificial Sequence
  Description of Artificial Sequence: Synthetic polynucleotide
atggccccaaagaagaagcggaaggtcggtatccacggagtcccagcagccctcgaaccaggtgaaaaaccttacaaatgtcctgaatgtgggaaatcattcagtcgcagcgacaacctggtgagacatcaacgcacccatacaggagaaaaaccttataaatgtccagaatgtggaaagtccttctcacgagaggataacttgcacactcatcaacgaacacatactggtgaaaaaccatacaagtgtcccgaatgtggtaaaagttttagccggagcgatgaacttgtccgacaccaacgaacccatacaggcgagaagccttacaaatgtcccgagtgtggcaagagcttctcacaatcagggaatctgactgagcatcaacgaactcataccggggaaaaaccttacaagtgtccagagtgtgggaagagcttttccacaagtggacatctggtacgccaccagaggacacatacaggggagaagccctacaaatgccccgaatgcggtaaaagtttctctcagaatagtaccctgaccgaacaccagcgaacacacactgggaaaaaaacgagtaaaaggccggcggccacgaaaaaggccggccaggcaaaaaagaaaaagggatcctacccatacgacgtaccagattacgctctcgaggaggccagcggttccggacgggctgacgcattggacgattttgatctggatatgctgggaagtgacgccctcgatgattttgaccttgacatgcttggttcggatgcccttgatgactttgacctcgacatgctcggcagtgacgcccttgatgatttcgacctggacatgctgattaactctagaagttccggatctccgaaaaagaaacgcaaagttggtagccagtacctgcccgacaccgacgaccggcaccggatcgaggaaaagcggaagcggacctacgagacattcaagagcatcatgaagaagtcccccttcagcggccccaccgaccctagacctccacctagaagaatcgccgtgcccagcagatccagcgccagcgtgccaaaacctgccccccagccttaccccttcaccagcagcctgagcaccatcaactacgacgagttccctaccatggtgttccccagcggccagatctctcaggcctctgctctggctccagcccctcctcaggtgctgcctcaggctcctgctcctgcaccagctccagccatggtgtctgcactggctcaggcaccagcacccgtgcctgtgctggctcctggacctccacaggctgtggctccaccagcccctaaacctacacaggccggcgagggcacactgtctgaagctctgctgcagctgcagttcgacgacgaggatctgggagccctgctgggaaacagcaccgatcctgccgtgttcaccgacctggccagcgtggacaacagcgagttccagcagctgctgaaccagggcatccctgtggcccctcacaccaccgagcccatgctgatggaataccccgaggccatcacccggctcgtgacaggcgctcagaggcctcctgatccagctcctgcccctctgggagcaccaggcctgcctaatggactgctgtctggcgacgaggacttcagctctatcgccgatatggatttctcagccttgctgggctctggcagcggcagccgggattccagggaagggatgtttttgccgaagcctgaggccggctccgctattagtgacgtgtttgagggccgcgaggtgtgccagccaaaacgaatccggccatttcatcctccaggaagtccatgggccaaccgcccactccccgccagcctcgcaccaacaccaaccggtccagtacatgagccagtcgggtcactgaccccggcaccagtccctcagccactggatccagcgcccgcagtgactcccgaggccagtcacctgttggaggatcccgatgaagagacgagccaggctgtcaaagcccttcgggagatggccgatactgtgattccccagaaggaagaggctgcaatctgtggccaaatggacctttcccatccgcccccaaggggccatctggatgagctgacaaccacacttgagtccatgaccgaggatctgaacctggactcacccctgaccccggaattgaacgagattctggataccttcctgaacgacgagtgcctcttgcatgccatgcatatcagcacaggactgtccatcttcgacacatctctgttt

SEQ ID NO: 443 - DNA, 816 bp, Artificial Sequence
  Description of Artificial Sequence: Synthetic polynucleotide
atggccccaaagaagaagcggaaggtcggtatccacggagtcccagcagccctcgaaccaggtgaaaaaccttacaaatgtcctgaatgtgggaaatcattcagtcgcagcgacaacctggtgagacatcaacgcacccatacaggagaaaaaccttataaatgtccagaatgtggaaagtccttctcacgagaggataacttgcacactcatcaacgaacacatactggtgaaaaaccatacaagtgtcccgaatgtggtaaaagttttagccggagcgatgaacttgtccgacaccaacgaacccatacaggcgagaagccttacaaatgtcccgagtgtggcaagagcttctcacaatcagggaatctgactgagcatcaacgaactcataccggggaaaaaccttacaagtgtccagagtgtgggaagagcttttccacaagtggacatctggtacgccaccagaggacacatacaggggagaagccctacaaatgccccgaatgcggtaaaagtttctctcagaatagtaccctgaccgaacaccagcgaacacacactgggaaaaaaacgagtaaaaggccggcggccacgaaaaaggccggccaggcaaaaaagaaaaagggatcctacccatacgacgtaccagattacgctctcgaggacgcgctggacgatttcgatctcgacatgctgggttctgatgccctcgatgactttgacctggatatgttgggaagcgacgcattggatgactttgatctggacatgctcggctccgatgctctggacgatttcgatctcgatatgtta

SEQ ID NO: 444 - DNA, 816 bp, Artificial Sequence; identical to SEQ ID NO: 443
  Description of Artificial Sequence: Synthetic polynucleotide

SEQ ID NO: 445 - DNA, 1893 bp, Artificial Sequence
  Description of Artificial Sequence: Synthetic polynucleotide
atggccgcggccaaggccgagatgcagctgatgtccccgctgcagatctctgacccgttcggatcctttcctcactcgcccaccatggacaactaccctaagctggaggagatgatgctgctgagcaacggggctccccagttcctcggcgccgccggggccccagagggcagcggcagcaacagcagcagcagcagcagcgggggcggtggaggcggcgggggcggcagcaacagcagcagcagcagcagcaccttcaaccctcaggcggacacgggcgagcagccctacgagcacctgaccgcagagtcttttcctgacatctctctgaacaacgagaaggtgctggtggagaccagttaccccagccaaaccactcgactgccccccatcacctatactggccgcttttccctggagcctgcacccaacagtggcaacaccttgtggcccgagcccctcttcagcttggtcagtggcctagtgagcatgaccaacccaccggcctcctcgtcctcagcaccatctccagcggcctcctccgcctccgcctcccagagcccacccctgagctgcgcagtgccatccaacgacagcagtcccatttactcagcggcacccaccttccccacgccgaacactgacattttccctgagccacaaagccaggccttcccgggctcggcagggacagcgctccagtacccgcctcctgcctaccctgccgccaagggtggcttccaggttcccatgatccccgactacctgtttccacagcagcagggggatctgggcctgggcaccccagaccagaagcccttccagggcctggagagccgcacccagcagccttcgctaacccctctgtctactattaaggcctttgccactcagtcgggctcccaggacctgaaggccctcaataccagctaccagtcccagctcatcaaacccagccgcatgcgcaagtaccccaaccggcccagcaagacgcccccccacgaacgcccttacgcttgcccagtggagtcctgtgatcgccgcttctcccgcagcgacaacctggtgagacacatccgcatccacacaggccagaagcccttccagtgccgcatctgcatgagaaacttcagccgagaggataacttgcacactcacatccgcacccacacaggcgaaaagcccttcgcctgcgacatctgtggaagaaagtttgcccggagcgatgaacttgtccgacataccaagatccacttgcggcagaaggaccgcccttacgcttgcccagtggagtcctgtgatcgccgcttctcccaatcagggaatctgactgagcacatccgcatccacacaggccagaagcccttccagtgccgcatctgcatgagaaacttcagcacaagtggacatctggtacgccacatccgcacccacacaggcgaaaagcccttcgcctgcgacatctgtggaagaaagtttgcccagaatagtaccctgaccgaacataccaagatccacttgcggcagaaggacaagaaagcagacaaaagtgttgtggctagctcggccacctcctctctctcttcctacccgtccccggttgctacctcttacccgtccccggttactacctcttatccatccccggccaccacctcatacccatcccctgtgcccacctccttctcctctcccggctcctcgacctacccatcccctgtgcacagtggcttcccctccccgtcggtggccaccacgtactcctctgttccccctgctttcccggcccaggtcagcagcttcccttcctcagctgtcaccaactccttcagcgcctccacagggctttcggacatgacagcaaccttttctcccaggacaattgaaatttgc

SEQ ID NO: 446 - DNA, 1740 bp, Artificial Sequence
  Description of Artificial Sequence: Synthetic polynucleotide
atggccgccgaccacctgatgctcgccgagggctaccgcctggtgcagaggccgccgtccgccgccgccgcccatggccctcatgcgctccggactctgccgccgtacgcgggcccgggcctggacagtgggctgaggccgcggggggctccgctggggccgccgccgccccgccaacccggggccctggcgtacggggccttcgggccgccgtcctccttccagccctttccggccgtgcctccgccggccgcgggcatcgcgcacctgcagcctgtggcgacgccgtaccccggccgcgcggccgcgccccccaacgctccgggaggccccccgggcccgcagccggccccaagcgccgcagccccgccgccgcccgcgcacgccctgggcggcatggacgccgaactcatcgacgaggaggcgctgacgtcgctggagctggagctggggctgcaccgcgtgcgcgagctgcccgagctgttcctgggccagagcgagttcgactgcttctcggacttggggtccgcgccgcccgccggctccgtgagctgcggtggttctggtggtggttctggtcagtcccagctcatcaaacccagccgcatgcgcaagtaccccaaccggcccagcaagacgcccccccacgaacgcccttacgcttgcccagtggagtcctgtgatcgccgcttctcccgcagcgacaacctggtgagacacatccgcatccacacaggccagaagcccttccagtgccgcatctgcatgagaaacttcagccgagaggataacttgcacactcacatccgcacccacacaggcgaaaagcccttcgcctgcgacatctgtggaagaaagtttgcccggagcgatgaacttgtccgacataccaagatccacttgcggcagaaggaccgcccttacgcttgcccagtggagtcctgtgatcgccgcttctcccaatcagggaatctgactgagcacatccgcatccacacaggccagaagcccttccagtgccgcatctgcatgagaaacttcagcacaagtggacatctggtacgccacatccgcacccacacaggcgaaaagcccttcgcctgcgacatctgtggaagaaagtttgcccagaatagtaccctgaccgaacataccaagatccacttgcggcagaaggacaagctcgagatggccgaccacctgatgctcgccgagggctaccgcctggtgcagaggccgccgtccgccgccgccgcccatggccctcatgcgctccggactctgccgccgtacgcgggcccgggcctggacagtgggctgaggccgcggggggctccgctggggccgccgccgccccgccaacccggggccctggcgtacggggccttcgggccgccgtcctccttccagccctttccggccgtgcctccgccggccgcgggcatcgcgcacctgcagcctgtggcgacgccgtaccccggccgcgcggccgcgccccccaacgctccgggaggccccccgggcccgcagccggccccaagcgccgcagccccgccgccgcccgcgcacgccctgggcggcatggacgccgaactcatcgacgaggaggcgctgacgtcgctggagctggagctggggctgcaccgcgtgcgcgagctgcccgagctgttcctgggccagagcgagttcgactgcttctcggacttggggtccgcgccgcccgccggctccgtgagctgc

SEQ ID NO: 447 - DNA, 1881 bp, Artificial Sequence
  Description of Artificial Sequence: Synthetic polynucleotide
atggccgcggccaaggccgagatgcagctgatgtccccgctgcagatctctgacccgttcggatcctttcctcactcgcccaccatggacaactaccctaagctggaggagatgatgctgctgagcaacggggctccccagttcctcggcgccgccggggccccagagggcagcggcagcaacagcagcagcagcagcagcgggggcggtggaggcggcgggggcggcagcaacagcagcagcagcagcagcaccttcaaccctcaggcggacacgggcgagcagccctacgagcacctgaccgcagagtcttttcctgacatctctctgaacaacgagaaggtgctggtggagaccagttaccccagccaaaccactcgactgccccccatcacctatactggccgcttttccctggagcctgcacccaacagtggcaacaccttgtggcccgagcccctcttcagcttggtcagtggcctagtgagcatgaccaacccaccggcctcctcgtcctcagcaccatctccagcggcctcctccgcctccgcctcccagagcccacccctgagctgcgcagtgccatccaacgacagcagtcccatttactcagcggcacccaccttccccacgccgaacactgacattttccctgagccacaaagccaggccttcccgggctcggcagggacagcgctccagtacccgcctcctgcctaccctgccgccaagggtggcttccaggttcccatgatccccgactacctgtttccacagcagcagggggatctgggcctgggcaccccagaccagaagcccttccagggcctggagagccgcacccagcagccttcgctaacccctctgtctactattaaggcctttgccactcagtcgggctcccaggacctgaaggccctcaataccagctaccagtcccagctcatcaaacccagccgcatgcgcaagtaccccaaccggcccagcaagacgcccccccacgaacgcccttacgcttgcccagtggagtcctgtgatcgccgcttctcccgctcagacaacctcgttcgacacatccgcatccacacaggccagaagcccttccagtgccgcatctgcatgagaaacttcagccaccggactacactcacgaaccacatccgcacccacacaggcgaaaagcccttcgcctgcgacatctgtggaagaaagtttgccagagaagacaatctccatactcacatccggacacacacgggagagaagccattcgcatgtgatatatgtgggagaaagttctccaccagccattctctcactgaacacatccgcatccacacaggccagaagcccttccagtgccgcatctgcatgagaaacttcagccagtctagctcactggtgaggcacatccgcacccacacaggcgaaaagcccttcgcctgcgacatctgtggaagaaagtttgccagggaggataacctgcatacgcataccaagatccacttgcggcagaaggacaagaaagcagacaaaagtgttgtggctagctcggccacctcctctctctcttcctacccgtccccggttgctacctcttacccgtccccggttactacctcttatccatccccggccaccacctcatacccatcccctgtgcccacctccttctcctctcccggctcctcgacctacccatcccctgtgcacagtggcttcccctccccgtcggtggccaccacgtactcctctgttccccctgctttcccggcccaggtcagcagcttcccttcctcagctgtcaccaactccttcagcgcctccacagggctttcggacatgacagcaaccttttctcccaggacaattgaaatttgc

SEQ ID NO: 448 - DNA, 1182 bp, Artificial Sequence
  Description of Artificial Sequence: Synthetic polynucleotide
atggccgccgaccacctgatgctcgccgagggctaccgcctggtgcagaggccgccgtccgccgccgccgcccatggccctcatgcgctccggactctgccgccgtacgcgggcccgggcctggacagtgggctgaggccgcggggggctccgctggggccgccgccgccccgccaacccggggccctggcgtacggggccttcgggccgccgtcctccttccagccctttccggccgtgcctccgccggccgcgggcatcgcgcacctgcagcctgtggcgacgccgtaccccggccgcgcggccgcgccccccaacgctccgggaggccccccgggcccgcagccggccccaagcgccgcagccccgccgccgcccgcgcacgccctgggcggcatggacgccgaactcatcgacgaggaggcgctgacgtcgctggagctggagctggggctgcaccgcgtgcgcgagctgcccgagctgttcctgggccagagcgagttcgactgcttctcggacttggggtccgcgccgcccgccggctccgtgagctgcggtggttctggtggtggttctggtcagtcccagctcatcaaacccagccgcatgcgcaagtaccccaaccggcccagcaagacgcccccccacgaacgcccttacgcttgcccagtggagtcctgtgatcgccgcttctcccgcagcgacaacctggtgagacacatccgcatccacacaggccagaagcccttccagtgccgcatctgcatgagaaacttcagccgagaggataacttgcacactcacatccgcacccacacaggcgaaaagcccttcgcctgcgacatctgtggaagaaagtttgcccggagcgatgaacttgtccgacataccaagatccacttgcggcagaaggaccgcccttacgcttgcccagtggagtcctgtgatcgccgcttctcccaatcagggaatctgactgagcacatccgcatccacacaggccagaagcccttccagtgccgcatctgcatgagaaacttcagcacaagtggacatctggtacgccacatccgcacccacacaggcgaaaagcccttcgcctgcgacatctgtggaagaaagtttgcccagaatagtaccctgaccgaacataccaagatccacttgcggcagaaggacaag

SEQ ID NO: 449 - DNA, 1740 bp, Artificial Sequence
  Description of Artificial Sequence: Synthetic polynucleotide
atggccgccgaccacctgatgctcgccgagggctaccgcctggtgcagaggccgccgtccgccgccgccgcccatggccctcatgcgctccggactctgccgccgtacgcgggcccgggcctggacagtgggctgaggccgcggggggctccgctggggccgccgccgccccgccaacccggggccctggcgtacggggccttcgggccgccgtcctccttccagccctttccggccgtgcctccgccggccgcgggcatcgcgcacctgcagcctgtggcgacgccgtaccccggccgcgcggccgcgccccccaacgctccgggaggccccccgggcccgcagccggccccaagcgccgcagccccgccgccgcccgcgcacgccctgggcggcatggacgccgaactcatcgacgaggaggcgctgacgtcgctggagctggagctggggctgcaccgcgtgcgcgagctgcccgagctgttcctgggccagagcgagttcgactgcttctcggacttggggtccgcgccgcccgccggctccgtgagctgcggtggttctggtggtggttctggtcagtcccagctcatcaaacccagccgcatgcgcaagtaccccaaccggcccagcaagacgcccccccacgaacgcccttacgcttgcccagtggagtcctgtgatcgccgcttctcccgctcagacaacctcgttcgacacatccgcatccacacaggccagaagcccttccagtgccgcatctgcatgagaaacttcagccaccggactacactcacgaaccacatccgcacccacacaggcgaaaagcccttcgcctgcgacatctgtggaagaaagtttgccagagaagacaatctccatactcataccaagatccacttgcggcagaaggaccgcccttacgcttgcccagtggagtcctgtgatcgccgcttctccaccagccattctctcactgaacacatccgcatccacacaggccagaagcccttccagtgccgcatctgcatgagaaacttcagccagtctagctcactggtgaggcacatccgcacccacacaggcgaaaagcccttcgcctgcgacatctgtggaagaaagtttgccagggaggataacctgcatacgcataccaagatccacttgcggcagaaggacaagctcgagatggccgaccacctgatgctcgccgagggctaccgcctggtgcagaggccgccgtccgccgccgccgcccatggccctcatgcgctccggactctgccgccgtacgcgggcccgggcctggacagtgggctgaggccgcggggggctccgctggggccgccgccgccccgccaacccggggccctggcgtacggggccttcgggccgccgtcctccttccagccctttccggccgtgcctccgccggccgcgggcatcgcgcacctgcagcctgtggcgacgccgtaccccggccgcgcggccgcgccccccaacgctccgggaggccccccgggcccgcagccggccccaagcgccgcagccccgccgccgcccgcgcacgccctgggcggcatggacgccgaactcatcgacgaggaggcgctgacgtcgctggagctggagctggggctgcaccgcgtgcgcgagctgcccgagctgttcctgggccagagcgagttcgactgcttctcggacttggggtccgcgccgcccgccggctccgtgagctgc

SEQ ID NO: 450 - DNA, 1182 bp, Artificial Sequence
  Description of Artificial Sequence: Synthetic polynucleotide
atggccgccgaccacctgatgctcgccgagggctaccgcctggtgcagaggccgccgtccgccgccgccgcccatggccctcatgcgctccggactctgccgccgtacgcgggcccgggcctggacagtgggctgaggccgcggggggctccgctggggccgccgccgccccgccaacccggggccctggcgtacggggccttcgggccgccgtcctccttccagccctttccggccgtgcctccgccggccgcgggcatcgcgcacctgcagcctgtggcgacgccgtaccccggccgcgcggccgcgccccccaacgctccgggaggccccccgggcccgcagccggccccaagcgccgcagccccgccgccgcccgcgcacgccctgggcggcatggacgccgaactcatcgacgaggaggcgctgacgtcgctggagctggagctggggctgcaccgcgtgcgcgagctgcccgagctgttcctgggccagagcgagttcgactgcttctcggacttggggtccgcgccgcccgccggctccgtgagctgcggtggttctggtggtggttctggtcagtcccagctcatcaaacccagccgcatgcgcaagtaccccaaccggcccagcaagacgcccccccacgaacgcccttacgcttgcccagtggagtcctgtgatcgccgcttctcccgctcagacaacctcgttcgacacatccgcatccacacaggccagaagcccttccagtgccgcatctgcatgagaaacttcagccaccggactacactcacgaaccacatccgcacccacacaggcgaaaagcccttcgcctgcgacatctgtggaagaaagtttgccagagaagacaatctccatactcataccaagatccacttgcggcagaaggaccgcccttacgcttgcccagtggagtcctgtgatcgccgcttctccaccagccattctctcactgaacacatccgcatccacacaggccagaagcccttccagtgccgcatctgcatgagaaacttcagccagtctagctcactggtgaggcacatccgcacccacacaggcgaaaagcccttcgcctgcgacatctgtggaagaaagtttgccagggaggataacctgcatacgcataccaagatccacttgcggcagaaggacaag

SEQ ID NO: 451 - DNA, 1893 bp, Artificial Sequence; identical to SEQ ID NO: 445
  Description of Artificial Sequence: Synthetic polynucleotide

SEQ ID NO: 452 - DNA, 1881 bp, Artificial Sequence
  Description of Artificial Sequence: Synthetic polynucleotide
atggccgcggccaaggccgagatgcagctgatgtccccgctgcagatctctgacccgttcggatcctttcctcactcgcccaccatggacaactaccctaagctggaggagatgatgctgctgagcaacggggctccccagttcctcggcgccgccggggccccagagggcagcggcagcaacagcagcagcagcagcagcgggggcggtggaggcggcgggggcggcagcaacagcagcagcagcagcagcaccttcaaccctcaggcggacacgggcgagcagccctacgagcacctgaccgcagagtcttttcctgacatctctctgaacaacgagaaggtgctggtggagaccagttaccccagccaaaccactcgactgccccccatcacctatactggccgcttttccctggagcctgcacccaacagtggcaacaccttgtggcccgagcccctcttcagcttggtcagtggcctagtgagcatgaccaacccaccggcctcctcgtcctcagcaccatctccagcggcctcctccgcctccgcctcccagagcccacccctgagctgcgcagtgccatccaacgacagcagtcccatttactcagcggcacccaccttccccacgccgaacactgacattttccctgagccacaaagccaggccttcccgggctcggcagggacagcgctccagtacccgcctcctgcctaccctgccgccaagggtggcttccaggttcccatgatccccgactacctgtttccacagcagcagggggatctgggcctgggcaccccagaccagaagcccttccagggcctggagagccgcacccagcagccttcgctaacccctctgtctactattaaggcctttgccactcagtcgggctcccaggacctgaaggccctcaataccagctaccagtcccagctcatcaaacccagccgcatgcgcaagtaccccaaccggcccagcaagacgcccccccacgaacgcccttacgcttgcccagtggagtcctgtgatcgccgcttctcccgcagcgacaacctggtgagacacatccgcatccacacaggccagaagcccttccagtgccgcatctgcatgagaaacttcagccgagaggataacttgcacactcacatccgcacccacacaggcgaaaagcccttcgcctgcgacatctgtggaagaaagtttgcccggagcgatgaacttgtccgacacatccggacacacacgggagagaagccattcgcatgtgatatatgtgggagaaagttctcccaatcagggaatctgactgagcacatccgcatccacacaggccagaagcccttccagtgccgcatctgcatgagaaacttcagcacaagtggacatctggtacgccacatccgcacccacacaggcgaaaagcccttcgcctgcgacatctgtggaagaaagtttgcccagaatagtaccctgaccgaacataccaagatccacttgcggcagaaggacaagaaagcagacaaaagtgttgtggctagctcggccacctcctctctctcttcctacccgtccccggttgctacctcttacccgtccccggttactacctcttatccatccccggccaccacctcatacccatcccctgtgcccacctccttctcctctcccggctcctcgacctacccatcccctgtgcacagtggcttcccctccccgtcggtggccaccacgtactcctctgttccccctgctttcccggcccaggtcagcagcttcccttcctcagctgtcaccaactccttcagcgcctccacagggctttcggacatgacagcaaccttttctcccaggacaattgaaatttgc

SEQ ID NO: 453 - DNA, 1881 bp, Artificial Sequence; identical to SEQ ID NO: 447
  Description of Artificial Sequence: Synthetic polynucleotide

SEQ ID NO: 454 - DNA, 4436 bp, Artificial Sequence; identical to SEQ ID NO: 363
  Description of Artificial Sequence: Synthetic polynucleotide

What is claimed is:

1. A composition comprising a polynucleotide, wherein the polynucleotide comprises a nucleic acid sequence encoding a non-naturally occurring DNA binding protein comprising a DNA binding domain, wherein the DNA binding domain is a zinc finger DNA binding domain comprising SEQ ID NO: 414.

2. The composition of claim 1, wherein the DNA binding domain binds a target site comprising SEQ ID NO: 38.

3. The composition of claim 1, wherein the DNA binding domain comprises an amino acid sequence having at least 80% sequence identity to a sequence selected from the group consisting of: SEQ ID NO: 26, SEQ ID NO: 93, and SEQ ID NO: 168.

4. The composition of claim 1, wherein the DNA binding domain comprises an amino acid sequence having at least 90% sequence identity to a sequence selected from the group consisting of: SEQ ID NO: 26, SEQ ID NO: 93, and SEQ ID NO: 168.

5. The composition of claim 1, wherein the DNA binding domain comprises a sequence selected from the group consisting of: SEQ ID NO: 26, SEQ ID NO: 93, and SEQ ID NO: 168.

6. The composition of claim 1, wherein the non-naturally occurring DNA binding protein further comprises a transcription activating domain (TAD), a nuclear localization sequence (NLS), or both.

7. The composition of claim 6, wherein the non-naturally occurring DNA binding protein further comprises the TAD and the NLS, and wherein the non-naturally occurring DNA binding protein is capable of upregulating endogenous progranulin (PGRN) expression in a cell.

8. The composition of claim 7, wherein the TAD is selected from the group consisting of: (i) VPR (SEQ ID NO: 114), VP64 (SEQ ID NO: 95), CITED2 (SEQ ID NO: 98), or CITED4 (SEQ ID NO: 97), (ii) a sequence having at least 80% sequence identity to SEQ ID NO: 114, 95, 98 or 97, or (iii) any combination of any one of (i) and (ii).

9. The composition of claim 7, wherein the DNA binding domain comprises an amino acid sequence having at least 90% sequence identity to a sequence selected from the group consisting of: SEQ ID NO: 26, SEQ ID NO: 93, and SEQ ID NO: 168.

10. The composition of claim 9, wherein the non-naturally occurring DNA binding protein comprises an amino acid sequence having at least 90% sequence identity to a sequence selected from the group consisting of: SEQ ID NO: 10, SEQ ID NO: 59, SEQ ID NO: 63, SEQ ID NO: 64, SEQ ID NO: 345, SEQ ID NO: 346, SEQ ID NO: 16, SEQ ID NO: 72, SEQ ID NO: 73, SEQ ID NO: 76, SEQ ID NO: 77, SEQ ID NO: 347, SEQ ID NO: 348, SEQ ID NO: 349, SEQ ID NO: 350, SEQ ID NO: 340, SEQ ID NO: 342, and SEQ ID NO: 343.

11. The composition of claim 10, wherein the non-naturally occurring DNA binding protein comprises the amino acid sequence selected from the group consisting of: SEQ ID NO: 10, SEQ ID NO: 59, SEQ ID NO: 63, SEQ ID NO: 64, SEQ ID NO: 345, SEQ ID NO: 346, SEQ ID NO: 16, SEQ ID NO: 72, SEQ ID NO: 73, SEQ ID NO: 76, SEQ ID NO: 77, SEQ ID NO: 347, SEQ ID NO: 348, SEQ ID NO: 349, SEQ ID NO: 350, SEQ ID NO: 340, SEQ ID NO: 342, and SEQ ID NO: 343.

12. The composition of claim 6, wherein the nucleic acid sequence encoding the non-naturally occurring DNA binding protein is part of an expression cassette, and wherein the expression cassette comprises a regulatory element operably linked to the nucleic acid sequence encoding the non-naturally occurring DNA binding protein.

13. The composition of claim 12, wherein the regulatory element is selected from the group consisting of: an intron, an enhancer, a promoter, a UTR, a stability element, a WPRE sequence, a Kozak consensus sequence, a posttranslational response element, a microRNA binding site, a polyadenylation (polyA) sequence, and any combination thereof.

14. The composition of claim 13, wherein the regulatory element comprises a nucleic acid sequence having at least 80% sequence identity to a sequence selected from the group consisting of: SEQ ID NO: 178, SEQ ID NO: 179, SEQ ID NO: 182, SEQ ID NO: 183, SEQ ID NO: 184, SEQ ID NO: 185, SEQ ID NO: 326, or SEQ ID NO: 327 and any combination thereof.

15. The composition of claim 13, wherein the regulatory element comprises a nucleic acid sequence having at least 90% sequence identity to a sequence selected from the group consisting of: SEQ ID NO: 178, SEQ ID NO: 179, SEQ ID NO: 182, SEQ ID NO: 183, SEQ ID NO: 184, SEQ ID NO: 185, SEQ ID NO: 326, or SEQ ID NO: 327, and any combination thereof.

16. The composition of claim 13, wherein the regulatory element is selected from the group consisting of: SEQ ID NO: 178, SEQ ID NO: 179, SEQ ID NO: 182, SEQ ID NO: 183, SEQ ID NO: 184, SEQ ID NO: 185, SEQ ID NO: 326, or SEQ ID NO: 327, and any combination thereof.

17. The composition of claim 12, wherein the expression cassette is incorporated into an expression vector.

18. The composition of claim 17, wherein the expression vector is an adeno-associated virus (AAV) vector.

19. The composition of claim 18, wherein the AAV vector is selected from the group consisting of: AAV1, AAV2, AAV3, AAV4, AAV5, AAV6, AAV7, AAV8, AAV9, AAV10, AAV11, AAV12, rh10, avian AAV, bovine AAV, canine AAV, equine AAV, primate AAV, non-primate AAV, ovine AAV, scAAV, scAAV1, scAAV2, scAAV5, scAAV8, scAAV9, and hybrids thereof.

20. The composition of claim 18, wherein the composition is a pharmaceutical composition comprising the AAV vector and one or more pharmaceutically acceptable excipients.

* * * * *